(12) United States Patent
Robinson et al.

(10) Patent No.: US 11,851,483 B2
(45) Date of Patent: Dec. 26, 2023

(54) ANTI-SCLEROSTIN ANTIBODIES AND THEIR USE TO TREAT BONE DISORDERS AS PART OF A REGIMEN

(71) Applicants: AMGEN INC., Thousand Oaks, CA (US); UCB PHARMA, S.A., Brussels (BE)

(72) Inventors: Martyn Kim Robinson, Shaftesbury (GB); Michael Stuart Ominsky, Thousand Oaks, CA (US); Xiaodong Li, Thousand Oaks, CA (US); Hua Zhu Ke, Berkshire (GB)

(73) Assignees: AMGEN INC., Thousand Oaks, CA (US); UCB PHARMA S.A., Brussels (BE)

( * ) Notice: Subject to any disclaimer, the term of this patent is extended or adjusted under 35 U.S.C. 154(b) by 0 days.

(21) Appl. No.: 15/534,635

(22) PCT Filed: Dec. 11, 2015

(86) PCT No.: PCT/EP2015/079496
§ 371 (c)(1),
(2) Date: Jun. 9, 2017

(87) PCT Pub. No.: WO2016/092101
PCT Pub. Date: Jun. 16, 2016

(65) Prior Publication Data
US 2018/0111986 A1 Apr. 26, 2018

Related U.S. Application Data

(60) Provisional application No. 62/091,155, filed on Dec. 12, 2014.

(51) Int. Cl.
| | | |
|---|---|---|
| *A61K 39/395* | (2006.01) | |
| *C07K 16/22* | (2006.01) | |
| *A61P 19/08* | (2006.01) | |
| *A61P 19/10* | (2006.01) | |
| *A61K 45/06* | (2006.01) | |
| *A61K 39/00* | (2006.01) | |

(52) U.S. Cl.
CPC .......... *C07K 16/22* (2013.01); *A61K 39/3955* (2013.01); *A61K 45/06* (2013.01); *A61P 19/08* (2018.01); *A61P 19/10* (2018.01); *A61K 2039/505* (2013.01); *A61K 2039/54* (2013.01); *A61K 2039/545* (2013.01); *C07K 2317/76* (2013.01); *C07K 2317/90* (2013.01); *C07K 2317/94* (2013.01)

(58) Field of Classification Search
CPC ..... A61K 39/3955; C07K 16/22; A61P 19/08; A61P 19/10
See application file for complete search history.

(56) References Cited

U.S. PATENT DOCUMENTS

| | | |
|---|---|---|
| 4,331,647 A | 5/1982 | Goldenberg |
| 4,376,110 A | 3/1983 | David et al. |
| 4,411,993 A | 10/1983 | Gillis |
| 4,427,115 A | 1/1984 | Laipply |
| 4,543,439 A | 9/1985 | Frackelton, Jr. et al. |
| RE32,011 E | 10/1985 | Zimmerman et al. |
| 4,837,440 A | 6/1989 | Burtscher et al. |
| 4,902,614 A | 2/1990 | Wakabayashi et al. |
| 5,070,108 A | 12/1991 | Margolis |
| 5,145,684 A | 9/1992 | Liversidge et al. |
| 5,223,409 A | 6/1993 | Ladner et al. |
| 5,399,363 A | 3/1995 | Liversidge et al. |
| 5,453,492 A | 9/1995 | Butzow et al. |
| 5,466,468 A | 11/1995 | Schneider et al. |
| 5,543,158 A | 8/1996 | Gref et al. |
| 5,552,157 A | 9/1996 | Yagi et al. |
| 5,565,213 A | 10/1996 | Nakamori et al. |

(Continued)

FOREIGN PATENT DOCUMENTS

| | | |
|---|---|---|
| JP | 4-141095 B2 | 8/2008 |
| WO | WO-91/013152 A1 | 9/1991 |

(Continued)

OTHER PUBLICATIONS

Lloyd et al., Protein Engineering, Design & Selection, 2009, vol. 22(3):159-168.*
Goel et al., J. Immunol., 2004, vol. 173(12):7358-7367.*
A diagram of a relevant part of the human genome (D64), citation in Appeal, European Patent No. 1133558, dated Apr. 15, 2010.
Abbas et. al. (Eds.), Cellular and Molecular Immunology, Third Edition, Section II, p. 54 (1997).
Alberts et. al. (Eds.), Molecular Biology of the Cell, Third Edition, Chapter 23, p. 1212 (1994).
Albertsen et. al., A physical map and candidate genes in the BRCA1 region on chromosome 17q12-21. *Nat. Genet.*, 7:472-9 (1994).

(Continued)

*Primary Examiner* — Xiaozhen Xie
(74) *Attorney, Agent, or Firm* — MARSHALL, GERSTEIN & BORUN LLP

(57) ABSTRACT

The invention relates to the treatment of bone disorders. In particular, the invention provides an approach involving administration of a high initial dose or doses of an sclerostin antibody to bring about a rapid increase in bone formation, followed by administration of lowers doses of the antibody to give a sustained lower rate of bone formation after the initial burst of bone formation. The invention also provides an approach involving decreasing dosing frequency with such an antibody to control bone formation. The approaches may be used in particular in those subjects who would benefit most from such an initial rapid burst of bone formation. Examples of such subjects include subjects who have been recently diagnosed or are experiencing severe symptoms of the disorder, as well as those subjects who have been administered a different treatment for the bone disorder which is proving ineffective. The approaches may be used in combination with each other.

13 Claims, 14 Drawing Sheets
Specification includes a Sequence Listing.

(56) References Cited

U.S. PATENT DOCUMENTS

| | | | |
|---|---|---|---|
| 5,567,434 A | 10/1996 | Szoka, Jr. |
| 5,571,714 A | 11/1996 | Dasch et al. |
| 5,627,052 A | 5/1997 | Schrader |
| 5,641,515 A | 6/1997 | Ramtoola |
| 5,698,426 A | 12/1997 | Huse |
| 5,738,868 A | 4/1998 | Shinkarenko |
| 5,780,263 A | 7/1998 | Hastings et al. |
| 5,795,587 A | 8/1998 | Gao et al. |
| 5,795,965 A | 8/1998 | Tsuchiya et al. |
| 5,811,238 A | 9/1998 | Stemmer et al. |
| 5,830,721 A | 11/1998 | Stemmer et al. |
| 5,837,458 A | 11/1998 | Minshull et al. |
| 5,877,397 A | 3/1999 | Lonberg et al. |
| 6,054,561 A | 4/2000 | Ring |
| 6,057,421 A | 5/2000 | Muller et al. |
| 6,117,911 A | 9/2000 | Grainger et al. |
| 6,133,426 A | 10/2000 | Gonzalez et al. |
| 6,180,370 B1 | 1/2001 | Queen et al. |
| 6,207,153 B1 | 3/2001 | Dan et al. |
| 6,395,511 B1 | 5/2002 | Brunkow et al. |
| 6,489,445 B1 | 12/2002 | Brunkow et al. |
| 6,495,736 B1 | 12/2002 | Brunkow et al. |
| 6,703,199 B1 | 3/2004 | Koide |
| 6,803,453 B1 | 10/2004 | Brunkow et al. |
| 6,806,055 B2 | 10/2004 | Berman et al. |
| 6,815,201 B2 | 11/2004 | Pinter |
| 6,818,748 B2 | 11/2004 | Fulton et al. |
| 7,192,583 B2 | 3/2007 | Brunkow et al. |
| 7,226,902 B2 | 6/2007 | Winkler et al. |
| 7,381,409 B2 | 6/2008 | Winkler et al. |
| 7,572,899 B2 | 8/2009 | Brunkow et al. |
| 7,578,999 B2 | 8/2009 | Winkler et al. |
| 7,592,429 B2 | 9/2009 | Paszty et al. |
| 7,642,238 B2 | 1/2010 | Shaughnessy |
| 7,758,858 B2 | 7/2010 | Brunkow et al. |
| 7,868,134 B2 | 1/2011 | Winkler et al. |
| 7,872,106 B2 | 1/2011 | Paszty et al. |
| 8,178,099 B2 | 5/2012 | Ellies |
| 2003/0165410 A1 | 9/2003 | Taylor |
| 2003/0166247 A1 | 9/2003 | Brunkow et al. |
| 2003/0186915 A1 | 10/2003 | Pan et al. |
| 2003/0229041 A1 | 12/2003 | Sutherland et al. |
| 2004/0009535 A1 | 1/2004 | Brunkow et al. |
| 2004/0023356 A1 | 2/2004 | Krumlauf et al. |
| 2004/0058321 A1 | 3/2004 | Brunkow et al. |
| 2004/0141875 A1 | 7/2004 | Doshi |
| 2004/0146888 A1 | 7/2004 | Paszty et al. |
| 2004/0158045 A1 | 8/2004 | Brunkow et al. |
| 2005/0014650 A1 | 1/2005 | Seitz et al. |
| 2005/0085418 A1 | 4/2005 | Winkler et al. |
| 2005/0106683 A1 | 5/2005 | Winkler et al. |
| 2005/0238646 A1 | 10/2005 | Ledbetter et al. |
| 2006/0233801 A1 | 10/2006 | Brunkow et al. |
| 2007/0072797 A1 | 3/2007 | Robinson et al. |
| 2007/0110747 A1 | 5/2007 | Paszty et al. |
| 2007/0292444 A1 | 12/2007 | Krumlauf et al. |
| 2008/0182788 A1 | 7/2008 | Brunkow et al. |
| 2008/0234219 A1 | 9/2008 | Brunkow et al. |
| 2009/0074763 A1* | 3/2009 | Padhi .............. C07K 16/18 424/133.1 |
| 2009/0117118 A1 | 5/2009 | Winkler et al. |
| 2009/0304713 A1 | 12/2009 | Paszty et al. |
| 2010/0015665 A1 | 1/2010 | Latham et al. |
| 2010/0036091 A1 | 2/2010 | Robinson et al. |
| 2010/0151524 A1 | 6/2010 | Winkler et al. |
| 2010/0226928 A1 | 9/2010 | Dani |
| 2011/0044978 A1 | 2/2011 | Ke |
| 2011/0097342 A1 | 4/2011 | Paszty et al. |
| 2011/0150866 A1 | 6/2011 | Brunkow et al. |

FOREIGN PATENT DOCUMENTS

| | | | |
|---|---|---|---|
| WO | WO-92/001047 A1 | 1/1992 | |
| WO | WO-92/002551 A1 | 2/1992 | |
| WO | WO-92/006693 A1 | 4/1992 | |
| WO | WO-95/030003 A2 | 11/1995 | |
| WO | WO-96/004375 A1 | 2/1996 | |
| WO | WO-98/021335 A1 | 5/1998 | |
| WO | WO-99/003996 A1 | 1/1999 | |
| WO | WO-99/006554 A2 | 2/1999 | |
| WO | WO-99/015556 A1 | 4/1999 | |
| WO | WO-00/32773 A1 | 6/2000 | |
| WO | WO-00/44777 A1 | 8/2000 | |
| WO | WO-00/075317 A2 | 12/2000 | |
| WO | WO-01/064885 A1 | 9/2001 | |
| WO | WO-01/092308 A2 | 12/2001 | |
| WO | WO-01/098491 A2 | 12/2001 | |
| WO | WO-02/24888 A2 | 3/2002 | |
| WO | WO-02/030463 A2 | 4/2002 | |
| WO | WO-03/050513 A2 | 6/2003 | |
| WO | WO-03/087763 A2 | 10/2003 | |
| WO | WO-03/106657 A2 | 12/2003 | |
| WO | WO-2004/082608 A2 | 9/2004 | |
| WO | WO-2004/094477 A1 | 11/2004 | |
| WO | WO-2004/098491 A2 | 11/2004 | |
| WO | WO-2005/003158 A2 | 1/2005 | |
| WO | WO-2005/014650 A2 | 2/2005 | |
| WO | WO-2005/115356 A2 | 12/2005 | |
| WO | WO-2006/015373 A2 | 2/2006 | |
| WO | WO-2006/065746 A2 | 6/2006 | |
| WO | WO-2006/102070 A2 | 9/2006 | |
| WO | WO-2006/119062 A2 | 11/2006 | |
| WO | WO-2006/119107 A2 | 11/2006 | |
| WO | WO-2007/080129 A1 | 7/2007 | |
| WO | WO-2008/061013 A2 | 5/2008 | |
| WO | WO-2008/092894 A1 | 8/2008 | |
| WO | WO-2008/115732 A2 | 9/2008 | |
| WO | WO-2008/133722 A2 | 11/2008 | |
| WO | WO-2009/039175 A2 | 3/2009 | |
| WO | WO-2009/047356 A1 | 4/2009 | |
| WO | WO-2009047356 A1 * | 4/2009 | .......... A61K 31/663 |
| WO | WO-2009/056634 A2 | 5/2009 | |
| WO | WO-2009/079471 A1 | 6/2009 | |
| WO | WO-2009/131553 A2 | 10/2009 | |
| WO | WO-2009/149189 A2 | 12/2009 | |
| WO | WO-2010/100179 A2 | 9/2010 | |
| WO | WO-2010/100200 A2 | 9/2010 | |
| WO | WO-2010/115932 A1 | 10/2010 | |
| WO | WO-2010/130830 A2 | 11/2010 | |
| WO | WO-2012/028683 A1 | 3/2012 | |
| WO | WO-2012/058393 A2 | 5/2012 | |
| WO | WO-2014/006100 A1 | 1/2014 | |

OTHER PUBLICATIONS

Alting-Mees et. al., Monoclonal antibody expression libraries: A rapid alternative to hybridomas. *Strat. Molec. Biol.*, 3:1-9 (1990).

Alves et. al., Sclerosteosis: A marker of Dutch ancestry? *Rev. Bras. Genet.*, 4:825-34 (1982).

Andersson et. al., Molecular genetics and pathophysiology of 17β-hydroxysteriod dehydrogenase 3 deficiency. *J. Clin. Endrocrinol. Metab.*, 81(1): 130-6 (1996).

Angal et. al., A single amino acid substitution abolishes the heterogeneity of chimeric mouse/human (IgG4) antibody. *Mol. Immunol.*, 30(1):105-8 (1993).

Annex EW6 to Declaration filed in connection with the European Patent EP 1133558 Opposition, Expert opinion of Prof. Dr. Edgar Wingender, dated Sep. 24, 2009.

Annex regarding the purported relevance of gene/peptides mentioned by Professor Arnett, dated Mar. 18, 2011.

Anonymous, Amgen presents denosumab and sclerostin antibody data at American Society for Bone and Mineral Research Annual Meeting. Amgen Media Press Release. www.amgen.com/media/media_pr_detail.jsp?releaseID=907028 (2006).

Anonymous, UCB on track. UCB News <http://hugin.info/133973/R/1176122/233395.pdf> (2007).

Arnett et. al., Effect of pH on bone resorption by rat osteoclasts in vitro. *Endocrinol.*, 119(1): 119-124 (1986).

Attana Application Example, cited in Opposition against European Patent No. 1721979 by Opponent: Novartis AG, dated Jun. 15, 2011.

(56) References Cited

OTHER PUBLICATIONS

Avsian-Kretchmer et. al., Comparative genomic analysis of the eight-membered ring cystine knot-containing bone morphogenetic protein antagonists. *Molec. Endocrinol.*, 18(1):1-12 (2004).
Babcook et. al., A novel strategy for generating monoclonal antibodies from single, isolated lymphocytes producing antibodies of defined specificities. *Proc. Natl. Acad. Sci. USA*, 93:7843-8 (1996).
Baines et. al., Purification of immunoglobulin G (IgG). *Meth. Molec. Biol.*, 10:79-104 (1992).
Balemans et. al., Extracellular regulation of BMP signaling in vertebrates: A cocktail of modulators. *Dev. Biol.*, 250:231-50 (2002).
Balemans et. al., Increased bone density in sclerosteosis is due to the deficiency of a novel secreted protein (SOST). *Hum. Mol. Genet.*, 10:537-43 (2001).
Balemans et. al., Localization of the gene for sclerosteosis to the van Buchem disease-gene region on chromosome 17q12-q21. *Am. J. Hum. Genet.*, 64:1661-9 (1999).
Balint et. al., Antibody engineering by parsimonious mutagenesis. *Gene*, 137(1):109-18 (1993).
Bateman et. al., Granulins: The structure and function of an emerging family of growth factors. *J. Endocrinol.*, 158: 145-51 (1998).
Baxevanis (Ed.) et. al., Bioinformatics: A practical guide to the analysis of genes and proteins, John Wiley & Sons, Inc. p. 234 (1998).
Beighton et. al., Heterozygous manifestations in the heritable disorders of the skeleton. *Pediatr. Radiol.*, 27: 397-401 (1997).
Beighton et. al., The clinical features of sclerosteosis. *Clin. Genet.*, 25:175-81 (1984).
Beighton et. al., The syndromic status of sclerosteosis and van Buchem disease. *Ann. Intern. Med.*, 84:393-7 (1976).
Bellows et. al., Parathyroid hormone reversibly suppresses the differentiation of osteoprogenitor cells in functional osteoblasts. *Endocrinol.*, 127(6): 3111-6 (1990).
Bendayan, Possibilities of false immunocytochemical results generated by the use of monoclonal antibodies: The example of the anti-proinsulin antibody. *J. Histochem. Cytochem.*, 43(9):881-6 (1995).
Bendig, Humanization of rodent monoclonal antibodies by CDR grafting. *Methods*, 8:83-93 (1995).
Bergfeld et. al., Release of ATP from human erythrocytes in response to a brief period of hypoxia and hypercapnia. *Cardiovascular Res.*, 26: 40-7 (1992).
Berman et. al., The protein data bank. *Acta. Cryst.*, 58(1):899-907 (2002).
Bigger versions of Figures from Declaration of Professor Teresa Attwood, citation in Appeal, European Patent No. 1133558, dated Apr. 13, 2010.
Bird et. al., Single-chain antigen-binding proteins. *Science*, 242:423-6 (1988).
Birren et. al., EMBL sequence database accession No. AC003098.2, Nov. 14, 1997.
Bishop (Ed.), Guide to Human Genome Computing, Second Edition, Academic Press, Chapter 1: Introduction to human genome computer via the world wide web, pp. 1-14 (2003).
Black et. al., A somatic cell hybrid map of the long arm of human chromosome 17, containing the familial breast cancer ILocus (BRCAI). *Am. J. Hum. Genet.*, 52:702-10 (1993).
Blum et. al., Study plan for German students in the summer of 1998, University Bioinformatik lecture announcement (1998).
Boden et. al., Glucocorticoid-induced differentiation of fetal rat calvarial osteoblasts is mediated by bone morphogenetic protein-6. *Endocrinology*, 138(7):2820-8 (1997).
Boerner et. al., Production of antigen-specific human monoclonal antibodies from in vitro-primed human splenocytes. *J. Immunol.*, 147:86-95 (1991).
Bonaldo et. al., EMBL Sequence Database Accession No. Al113131, Sep. 4, 1998.
Bonaldo et. al., Normalization and subtraction: Two approaches to facilitate gene discovery. *Genome Res.*, 6(9):791-806 (1996).
Bondestam, Ligands & Signaling Components of the Transforming Growth Factor, Helsinki University Biomedical Dissertations (2002).
Bork et. al., Go hunting in sequence databases by watch out for the traps. *Trends Genet.*, 12: 425-7 (1996).
Bos et. al., Ras ongogenes in human cancer: A review. *Cancer Res.*, 49: 4682-9 (1989).
Bost et. al., Antibodies against a peptide sequence within the HIV envelope protein crossreacts with human interleukin-2. *Immunol. Invest.*, 17(6&7):577-86 (1988).
Bostrom et. al., Ligand and signaling components of the transforming growth factor β family. *J. Orth. Res.*, 13:357-67 (1995).
Bottcher et. al., NCBI Sequence database accession No. NM_004329, Aug. 2, 2009.
Bouffard et. al., A physical map of human chromosome 7: An integrated YAC contig map with average STS spacing of 79 kb. *Genome Res.*, 7: 673-92 (1997).
Bowie et. al., A method to identify protein sequences that fold into a known three-dimensional structure. *Science*, 253:164-70 (1991).
Bowie et. al., Deciphering the message in protein sequences: Tolerance to amino acid substitutions. *Science*, 247(4948):1306-10 (1990).
Bradley et. al., Modifying the mouse: Design and desire. *Bio/Technology*, 10:534-9 (1992).
Brandao-Burch et. al., Acidosis inhibits bone formation by osteoblasts in vitro by preventing mineralization. *Calcif. Tissue Int.*, 77: 167-74 (2005).
Brenner et. al., Population statistics of protein structures: Lessons from structural classifications. *Curr. Op. Struct. Biol.*, 7(3):369-76 (1997).
Brown, Hybridization analysis of DNA blots, *Current Protocols in Protein Science*, 13:A.4H.1-A.4H.9 (1990).
Brown, Hybridization Analysis of DNA Blots, *Current Protocols in Protein Science*, 2.10.1-2.10.16 (2000).
Bruggemann et. al., Production of human antibody repertoires in transgenic mice. *Curr. Opin. Biotechnol.*, 8:455-8 (1997).
Brunkow et. al., Bone dysplasia sclerosteosis results from loss of the SOST gene product, a novel cysteine knot-containing protein. *Am. J. Hum. Genet.*, 68:577-89 (2001).
Burton et. al., Human antibodies from combinatorial libraries. *Adv. Immunol.*, 57:191-280 (1994).
Butcher et. al., Increased salt concentration reversibly destabilizes p53 quaternary structure and sequence-specific DNA binding. *Biochem. J.*, 298: 513-6 (1994).
Byrne et. al., CD4+CD45RBHi T cell transfer induced colitis in mice is accompanied by osteopenia which is treatable with recombinant human osteoprotegerin. *Gut.*, 54:78-86 (2005).
Campbell et. al., Totipotency or multipotentiality of cultured cells: Applications and progress. *Theriogenology*, 47:63-72 (1997).
Caverzasio et. al., Characteristics and regulation of Pi transport in osteogenic cells for bone metabolism. *Kindey Int.*, 49: 975-80 (1996).
Chan et. al., A new paradigm in the treatment of osteoporosis: Wnt pathway proteins and their antagonists. *Curr. Opin. Invest. Drugs*, 8:293-8 (2007).
Chandran et. al., Recent trends in drug delivery systems: Liposomal drug delivery system—Preparation and characterization. *Indian J. Exp. Biol.*, 35(8):801-9 (1997).
Charlier et. al., A pore mutation in a novel KQT-like potassium channel gene in an idiopathic epilepsy family. *Nat. Genet.*, 18:53-5 (1998).
Chenu et. al., Glutamate receptors are expressed by bone cells and are involved in bone resorption. *Bone*, 22(4): 295-9 (1998).
Chou et. al., Empirical predication of protein conformation. *Ann. Rev. Biochem.*, 47:251-76 (1979).
Chou et. al., Prediction of the secondary structure of proteins from their amino acid sequence. *Adv. Enzymol. Relat. Areas Mol. Biol.*, 47:145-8 (1978).
Clark, Antibody humanization: A case of the 'Emperor's New Clothes' ?. *Immunology Today*, 21(8):397-402 (2000).
Clinical Trial NCT02337387 (2012). Available at URL:<https://clinicaltrials.gov/ct2/results?cond=&term=LY2541546&entry=&state=&city=&dist>.

(56) References Cited

OTHER PUBLICATIONS

Cogan et. al., NCBI Sequence Database Accession No. NM_033346, Jul. 19, 2005.
Collins, Identifying human disease genes by positional cloning. *The Harvey Lectures*, Series 86:149-64 (1992).
Collins, Positional cloning moves from perditional to traditional. *Nat. Genet.*, 9:347-50 (1995).
Colman, Effects of amino acid sequence changes on antibody-antigen interactions. *Biomolec. Res. Inst.*, 55:33-6 (1994).
Communication from the European Patent Office providing an "Observation by a Third Party according to Article 115 EPC" submitted in connection with the Opposition to European Patent No. 1 133 558, dated Dec. 3, 2008.
Cook et. al., Structural basis for a functional antagonist in the transforming growth factor β superfamily. *J. Biol. Chem.*, 280(48):40177-86 (2005).
Cormier, Markers of bone metabolism. *Curr. Opin. in Rheu.*, 7:243-8 (1995).
Couvreur et. al., Polyalkylcyanoacrylates as colloidal drug carriers. *Crit. Rev. Ther. Drug Carrier Syst.*, 5(1):1-20 (1988).
Craig et. al., Sclerostin binds and regulates the activity of cysteine rich protein 61. *Biochem. Biophys. Res. Commun.*, 293(1): 36-40 (2010).
Craig et. al., Sclerostin-erbB-3 interactions: Modulation of erbB-3 activity by sclerostin. *Biochem. Biophys. Res. Commun.*, 402: 421-4 (2010).
Crameri et. al., DNA shuffling of a family of genes from diverse species accelerates directed evolution. *Nature*, 391:288-91 (1998).
Dall'Acqua et. al., Antibody humanization by framework shuffling. *Methods*, 36(1):43-60 (2005).
Davies, et. al., Affinity improvement of single antibody VH domains: Residues in all three hypervariable regions affect antigen binding. *Immunotechnology*, 2(3): 169-79 (1996).
De Jong et. al., Evolution of the α-crystallin/small heat-shock protein family. *Mol. Biol. Evol.*, 10(1): 103-26 (1993).
Dean et. al., Matrix vesicles produced by osteoblast-like cells in culture become significantly enriched in proteoglycan-degrading metalloproteinases after addition of β-glycerophosphate and ascorbic acid. *Calcif. Tissue*, 54: 399-408 (1994).
Declaration filed in connection with the European Patent EP 1133558 Opposition, Expert opinion of Dr. Auristela Freire de Paes Alves, Ph.D., dated Sep. 9, 2009.
Declaration filed in connection with the European Patent EP 1133558 Opposition, Expert opinion of Dr. Walter Sebald, dated Sep. 24, 2009.
Declaration filed in connection with the European Patent EP 1133558 Opposition, Expert opinion of Prof. Dr. Edgar Wingender, dated Sep. 24, 2009.
Declaration filed in connection with the European Patent EP 1133558 Opposition, Expert opinion of Prof. Dr. Thomas Muller, dated Sep. 23, 2009.
Declaration of Alistair J. Henry, citation in Appeal, European Patent No. 1133558, dated Apr. 2, 2010.
Declaration of Dr. Martyn Robinson, submitted in Opposition to European Patent No. 1133558, dated Jan. 13, 2008.
Declaration of Dr. Mary E. Brunkow, submitted in Opposition to European Patent No. 1133558, dated Jan. 9, 2008.
Declaration of Dr. Raymond Dalgleish dated Dec. 8, 2011, citation in Appeal, European Patent No. 1133558.
Declaration of Prof. Edgar Wingender filed in connection with that Opposition regarding European Patent EP 1133558 B1, dated Mar. 10, 2011.
Declaration of Professor Teresa Attwood, citation in Appeal, European Patent No. 1133558, dated Apr. 13, 2010.
Declaration of Tim Arnett, citation in Appeal, European Patent No. 1133558, dated Apr. 2, 2010.
Delmas et. al., The use of biochemical markers of bone turnover in osteoporosis. *Osteoporosis International*, Suppl. 6:S2-17 (2000).
Diagram of the candidate interval, citation by Propriator in Opposition against European Patent No. 1721979 on Feb. 20, 2012.
Ducy et. al., 5-HT and bone biology. *Curr. Opin. Pharmacol.*, 11: 34-8 (2011).
Ducy et. al., Genetic control of cell differentiation in the skeleton. *Curr. Opin. Cell Biol.*, 10: 614-9 (1998).
Durham et. al., Alterations in insulin-like growth factor (IGF)-dependent IGF-binding protein-4 proteolysis in transformed osteoblastic cells. *Endocrinology*, 136(4):1374-80 (1995).
Ebara et. al., Mechanism for the action of bone morphogenetic proteins and regulation of their activity. *Spine*, 27(165):S10-5 (2002).
Eddleston et al., A short treatment with an antibody to sclerostin can inhibit bone loss in an ongoing model of colitis., J. Bone Miner. Res., 24:1662-71 (2009).
Eli Lilly Statement of Grounds of Appeal, Opposition to European Patent Application No. 1133558 B1, dated Sep. 28, 2009.
Eli Lilly, Biacore experiment comparison results, Setup assay to measure BMP binding to captured SOST, referenced on p. 41 of reference C193, dated Sep. 28, 2009.
Epstein et. al., Endocrine function in sclerosteosis. *S. Afr. Med. J.*, 55:1105-10 (1979).
European Patent Office Communication, Opposition to European Patent No. 1133558, dated Nov. 4, 2008.
European Patent Office, "Opinion of the Enlarged Board of Appeal dated Dec. 1992 G 1/92", available from [http://documents.epo.org/projects/babylon/eponet.nsf/0/907016FA57B46FD0C12572C8006CD2E2/$File/g920001.pdf], cited Jun. 15, 2011.
Expert Opinion from Dr. Catalina Lopez-Correa, submitted in Opposition to European Patent No. 1133558, dated Mar. 6, 2009.
Expert opinion of Professor Dr.-Ing Ulrich Vollrath, citation in Appeal of European Patent No. 1133558, dated Apr. 12, 2005.
Extract from Sigma Aldrich catalogue, cited in Opposition against European Patent No. 1721979 by Opponent: Laudens, dated Jun. 15, 2011.
Eyre et. al., Characterization of aromatase and 17β-hydroxysteroid dehydrogenase expression in rat osteoblastic cells. *J. Bone Miner. Res.*, 13(6): 996-1004 (1998).
Foster et. al., Establishment of interference in osteoblasts by an osteopetrosis-inducing Avian Leukosis virus. *Virology*, 205: 376-8 (1994).
Fouser et. al., Feedback regulation of collagen gene expression: A Trojan horse approach. *Proc. Natl. Acad. Sci. USA*, 88: 10158-62 (1991).
Frost et. al., On the rat model of human osteopenias and osteoporoses. *Bone and Mineral*, 18:227-36 (1992).
Fujiwara et. al., GenBank Sequence Database Accession No. D79813, Feb. 9, 1996.
Gardner et. al., Bone mineral density in sclerosteosis; Affected individuals and gene carriers. *J. Clin. Endocrinol. Metab.*, 90(12): 6392-5 (2005).
Gavarini et. al., Opposite effects of PSD-95 and MPP3 Pdz proteins on serotonin 5-hydroxytryptamine2C receptor desensitization and membrane stability. *Molec. Biol.*, 17: 4619-31 (2006).
Gazzerro et. al., Bone morphogenetic proteins induce the expression of noggin which limits their activity in cultured rat osteoblasts. *J. Clin. Invest.*, 102(12):2106-14 (1998).
Gazzerro et. al., Potential drug targets within bone morphogenetic protein signaling pathways. *Curr. Opin. Pharmacol.*, 7: 325-3 (2007).
Geissler et la., Male pseudohermaphroditism caused by mutations of testicular 17β-hydroxysteroid hehydrogenase 3. *Nat. Genetics*, 7: 34-9 (1994).
Gencic et. al., Conservative amino acid substitution in the myelin proteolipid protein of Jimpymsd mice. *J. Neurosci.*, 10(1):117-24 (1990).
Geysen et. al., Cognitive features of continuous antigenic determinants. *J. Molec. Recog.*, 1(1):32-41 (1988).
Gitelman et. al., Vgr-1/BMP-6 induces osteoblastic differentiation of pluripotential mesenchymal cells. *Cell Growth & Differentiation*, 6:827-36 (1995).
Glasky et. al., Stability of specific immunoglobulin secretion by EBV-transformed lymphoblastoid cells and human-murine heterohybridomas. *Hybridoma*, 8:377-89 (1989).

(56) References Cited

OTHER PUBLICATIONS

Gowen et. al., Actions of recombinant human γ-interferon and tumor necrosis factor α on the proliferation and osteoblastic characteristics of human trabecular bone cells in vitro. *Arthritis Rheumatism*, 31(12): 1500-7 (1988).
Graner et. al., Splice variants of the Drosophila PS2 integrins differentially interact with RGD-containing fragments of the extracellular proteins tiggrin, Ten-m and D-laminin α2. *J. Biol. Chem.*, 273(29): 18235-41 (1998).
Green et al., Cytosolic pH regulation in osteoblasts. *J. Gen. Physiol.*, 95: 121-45 (1990).
Green et. al., Antigen-specific human monoclonal antibodies from mice engineered with human Ig heavy and light chain YACs. *Nat. Genet.*, 7:13 (1994).
Greene et. al., Screening Recombinant DNA Libraries. *Current Protocols in Molecular Biology*, Ch. 6(1) (1990).
Gribskov et. al., Profile analysis. *Meth. Enzym.*, 183:146-59 (1990).
Gribskov et. al., Profile analysis: Detection of distantly related proteins. *Proc. Nat. Acad. Sci. USA*, 84(13):4355-8 (1987).
Groeneveld et. al., Bone morphogenetic proteins in human bone regeneration. *Eur. J. Endocrinol.*, 142:9-21 (2000).
Gronthos et. al., Integrin expression and function on human osteoblast-like cells. *J. Bone Miner. Res.*, 12(8): 1189-97 (1997).
Groppe et. al., Structural basis of BMP signalling inhibition by the cystine knot protein noggin. *Nature*, 420:636-42 (2002).
Guinness-Hey, Increased trabecular bone mass in rats treated with human synthetic parathyroid hormone. *Metab. Bone Dis. Relat. Res.*, 5:177-81 (1984).
Harlow et. al., Antibodies: A Laboratory Manual, Cold Spring Harbor Laboratory, 141-157 (1988).
Harris, Processing of C-terminal lysine and arginine residues of proteins isolated from mammalian cell culture. *J. Chromatogr.*, 705:129-34 (1995).
Hart et. al., Crystal structure of the human TBR2 ectodomain-TGF-β3 complex. *Nat. Struc. Biol.*, 9(3):203-8 (2002).
Hay et. al., ATCC Cell Line and Hybridomas, American Type Culture Collection, 8th Ed., pp. 149, 258, 428 (1994).
He et. al., High-throughput dynamic light scattering method for measuring viscosity of concentrated protein solutions. *Anal. Biochem.*, 399(1): 141-3 (2010).
Heinecke et. al., Receptor oligomerization and beyond: A case study in bone morphogenetic proteins, *BMC Biol.*, 7: 59 (2009).
Hill et. al., Multiple extracellular signals promote osteoblast survival and apoptosis. *Endocrinology*, 138(9):3849-58 (1997).
Hillier et. al., EMBL Sequence Database Accession No. AA393939, May 19, 1997.
Hillier et. al., GenBank Sequence Database Accession No. AA393768, Apr. 24, 1997.
Hillier et. al., Generation and analysis of 280,000 human expressed sequence tags. *Genome Res.*, 6: 807-28 (1996).
Hilliker et. al., Truncation of the amino terminus of PTH alters its anabolic activity on bone in vivo. *Bone*, 19(5): 469-77 (1996).
Hirschhorn, Letter to the Editor: Dominance and Homozygosity in Man. *Am. J. Med. Genetics*, 18: 541 (1984).
Hock et. al., Perspective: Osteoblast apoptosis and bone turnover. *J. Bone Miner. Res.*, 16(6):975-84 (2001).
Hoffman et. al., BMP Signaling Pathways in Cartilage and Bone Formation, *Crit. Rev. Eukaryotic Gene Exp.*, 11(1-3):23-45 (2001).
Hoggard et. al., Localization of leptin receptor mRNA splice variants in murine peripheral tissues by RT-PCR and in situ hybridization. *Biochem. Biophys. Res. Commun.*, 232: 383-7 (1997).
Hollinger et. al., Engineered antibody fragments and the rise of single domains. *Nat. Biotech.*, 23(9):1126-36 (2005).
Holm et. al., Protein folds and families: Sequence and structure alignments. *Nucl. Acid Res.*, 27(1):244-7 (1999).
Holt, et. al., Domain antibodies: Proteins for therapy. *Trends Biotechnol.*, 21(11):484-90 (2003).
Hoogenboom et. al., By-passing immunisation: Human antibodies from synthetic repertoires of germline VH gene segmens rearranged in vitro. *J. Molec. Biol.*, 227:381-8 (1992).

Hoogewerf et. al., Glycosaminoglycans mediate cell surface oligomerization of chemokines. *Biochemistry*, 36: 13570-8 (1997).
Horton et. al., Arg-Gly-Asp (RGD) peptides and the anti-vitronectin receptor antibody 23C6 inhibit dentine resorption and cell spreading by osteoclasts. *Exp. Cell Res.*, 195: 368-75 (1991).
Hsu et. al., The Xenopus dorsalizing factor gremlin indentified a novel family of secreted proteins that antagonize BMP activities. *Molec. Cell*, 1:673-83 (1998).
Hufner et. al., Evidence for an osteoblast-activating factor in a patient with peripheral T-cell lymphoma and osteosclerosis. *Klin. Wochenscher.*, 67: 402-7 (1989).
Hulley et. al., Inhibition of mitogen-activated protein kinase activity and proliferation of an early osteoblast cell line (MBA 15.4) by dexamethasone: Role of protein phosphatases. *Endocrinol.*, 139(5): 2423-31 (1998).
Huse et. al., Generation of a large combinatorial library of the immunoglobulin repertoire in phage lambda. *Science*, 246:1275-81 (1989).
Hwang et. al., Use of human germline genes in a CDR homoloy-based approach to antibody humanization. *Methods*, 36(1):35-42 (2005).
Ide et. al., GenBank Sequence Database Accession No. BAA19765, Feb. 7, 1999.
Ide et. al., GenBank Sequence Datacase Accession No. D89675, Feb. 7, 1999.
Iemura et. al., Direct binding of follistatin to a complex of bone-morphogenetic protein and its receptor inhibits ventral and epidermal cell fates in early Xenopus embryo. *Proc. Natl. Acad. Sci. USA*, 95:9337-42 (1998).
Innis et. al., Evolutionary trace analysis of TGF-B and related growth factors: Implications for stie-directed mutagenesis. *Protein Engineering*, 13(12):839-47 (2000).
International Preliminary Report on Patentability for Application No. PCT/EP2015/079496, dated Jun. 13, 2017.
International Search Report and Written Opinion for Application No. PCT/EP2015/079496, dated Apr. 14, 2016.
Jakobovits et. al., Production of antigen-specific human antibodies from mice engineered with human heavy and light chain YACsa. *Ann. N.Y. Acad. Sci.*, 764:525-35 (1995).
Jee et. al., Overview: Animal models of osteopenia and osteoporosis. *J. Musculoskel. Neuron. Interact.*, 1:193-207 (2001).
Jilka et. al., Increased bone formation by prevention of osteoblast apoptosis with parathyroid hormone. *J. Clin. Invest.*, 104:439-46 (1999).
Jilka et. al., Osteoblast programmed cell death (apoptosis): Modulation by growth factors and cytokines. *J. Bone Miner. Res.*, 13(5): 793-802 (1998).
Jones, Progress in protein structure predication. *Curr. Opin. Struct. Biol.*, 7(3):377-387 (1997).
Kabat et. al., Sequences of proteins of immunological interest, U.S. Department of Health and Human Services, *NIH, USA* (1987) (Table of Contents).
Kalu, The ovariectomized rat model of postmenopausal bone loss. *Bone and Mineral*, 15:175-92 (1991).
Kang et. al., Linkage of recognition and replication functions by assembling combinatorial antibody Fab libraries along phage surfaces. *Proc. Natl. Acad. Sci. USA*, 88:4363-6 (1991).
Katagiri et. al., The non-osteogenic mouse pluripotent cell line, C3H10T1/2, is induced to differentiate into osteoblastic cells by recombinant human bone morphogenetic protein-2. *Biochem. Biophys. Res. Comm.*, 172(1):295-9 (1990).
Kawabata et. al., Signal transduction by bone morphogenetic proteins. *Cytokine and Growth Factor Reviews*, 9(1):49-61 (1998).
Keller et. al., Molecular recognition of BMP-2 and BMP receptor IA. *Nat. Struct. Mol. Biol.*, 11(5):481-488 (2004).
Khalil, TGF-β: From latent to active. *Microbes and Infection*, 1(15):1255-63 (1999).
Khosla et. al., Concise review for primary-care physicians. Treatment pptions for osteoporosis. *Mayo Clin. Proc.*, 70:978-82 (1995).
Kirsch et. al., BMP-2 antagonists emerge from alterations in the low-affinity binding epitope for receptor BMPR-II, *Embo J.*, 19(13): 3314-24 (2000).

(56) References Cited

OTHER PUBLICATIONS

Kohler et. al., Continuous cultures of fused cells secreting antibody of predefined specificity. *Nature*, 256:495 (1975).
Koli et. al., Latency, activation, and binding proteins of TGF-. *Microscopy Res. Tech.*, 52:354-62 (2001).
Koreth et. al., Microsatellites and PCR genomic analysis. *J. Pathology*, 178:239-48 (1996).
Kouadjo et al., "Housekeeping and tissue-specific genes in mouse tissues," BMC Genomics, 8:127 (2007).
Kramer et. al., The gapped duplex DNA approach to oligonucleotide-directed mutation construction. *Nuc. Acids Res.*, 12:9441 (1984).
Krause et. al., Distinct modes of inhibition by sclerostin on bone morphogenetic protein and Wnt signaling pathways. *J. Biol. Chem.*, 285(53): 41614-26 (2010).
Kunkel et. al., Rapid and efficient site-specific mutagenesis without phenoypic selection. *Meth. Enzymol.*, 154:367-82 (1987).
Kunkel, Rapid and efficient site-specific mutagenesis without phenotypic selection. *Proc. Natl. Acad. Sci. USA*, 82:488-92 (1985).
Kurahashi et. al., Regions of genomic instability on 22q11 and 11q23 as the etiology for the recurrent constitutional t (11;22). *Hum. Molec. Genet.*, 9: 1665-70 (2000).
Kusu et. al., Sclerostin is a novel secreted osteoclast-dervied bone morphogenetic protein antagonist with unique ligand specificity. *J. Biol. Chem.*, 278:24113-7 (2003).
Labat et. al., Retroviral expression in mononuclear blood cells isolated from a patient with osteopetrosis (Albers-Schonberg disease). *J. Bone Miner. Res.*, 5(5): 425-35 (1989).
Labat, A new approach to the study of the origin of genetic disease: Retroviral etiology of osteopetrosis. *Biomed. Pharmacother.*, 45: 23-7 (1991).
Lasic, Novel applications of liposomes. *Trends Biotechnol.*, 16(7):307-21 (1998).
Latham, The biochemical and cellular characterization of sclerostin, The causative gene for sclerostenosis. *Calcified Tissue International*, 70(4):244 (2002).
Leppert et. al., Benign familial neonatal epilepsy with mutations in two potassium channel genes. *Curr. Opin. Neurol.*, 12: 143-7 (1999).
Lewiecki et. al., Sclerostin monoclonal antibody therapy with AMG 785: A potential treatment for osteoporosis. *Exp. Opin. Biol. Ther.*, 11(1): 117-27 (2011).
Li et. al., Sclerostin binds to LRP5/6 and antagonizes canonical Wnt signaling. *J. Biol. Chem.*, 280: 19883-7 (2005).
Li et. al., Treatment with an anti-sclerostin antibody directly stimulates bone formation in a dose-dependent manner in ovariectomized rats with established osteopenia. *J. Bone Min. Res.*, 22(Suppl. S1): S65 (2007).
Lian et. al., Bone Formation: Osteoblast Lineage Cells, Growth Factors, Matrix Proteins, and the Mineralization Process, Primer on the Metabolic Bone Diseases and Disorders of Mineral Metabolism, 4th Edition, 14-29 (1999).
Lierop et. al., Van Buchem disease: Clinical, biochemical and densitometric features of patients and disease carriers. *J. Bone Miner. Res. Accepted Article* (2012).
Liu et. al., GenBank Sequence Database Accession No. U25110, Feb. 2, 1996.
Liu et. al., Human type II receptor for bone morphogenic proteins (BMPs): Extension of the two-kinase receptor model to the BMPs. *Molec. Cell. Biol.*, 15(7):3479-86 (1995).
Lonberg et. al., Antigen-specific human antibodies from mice comprising four distinct genetic modifications. *Nature*, 368:856 (1994).
Loots et. al., Genomic deletion of a long-range bone enhancer misregulates sclerostin in Van Buchem disease. *Genome Res.*, 15: 928-35 (2005).
Low et. al., Mimicking somatic hypermutation: Affinity maturation of antibodies displayed on bacteriophage using a bacterial mutator strain. *J. Mol. Biol.*, 250:350-68 (1996).

Lowik et. al., Wnt signaling is involved in the inhibitory action of sclerostin on BMP-stimulated bone formation. *J. Musculoskeleton Neuronal Interact.* 6: 357 (2006).
Luckman et. al., Heterocycle-containing bisphosphonates cause apoptosis and inhibit bone resorption by preventing protein prenylation: Evidence from structure-activity relationships in J774 macrophages. *J. Bone Miner. Res.*, 13(11): 1668-78 (1998).
Luckman et. al., Nitrogen-containing bisphosphonates inhibit the mevalonate pathway and prevent post-translational prenylation of GTP-binding proteins, including Ras. *J. Bone Miner. Res.*, 13(4): 581-9 (1998).
Malone et. al., Bone anabolism achieved by reducing sclerostin bioavailability with an anti-sclerostin antibody. 37th International Sun Valley Workshop on Skeletal Tissue Biology. Aug. 5-8, 2007.
Mango et. al., Carboxy-terminal truncation activates glp-1 protein to specify vulval fates in Caenorhabditis elegans. *Lett. Nature*, 352: 811-15 (1991).
Margalit et. al., Comparative analysis of structurally defined herparin binding sequences reveals a distinct spatial distribution of basic residues. *J. Biol. Chem.*, 268 (26): 19228-31 (1993).
Margalit, Liposome-mediated drug targeting in topical and regional therapies. *Crit. Rev. Ther. Drug Carrier Syst.*, 12(2-3):233-61 (1995).
Marks et. al., By-passing immunization: Building high affinity human antibodies by chain shuffling. *Bio/Technology*, 10:779-83 (1992).
Matthews et. al., Adenovirus protein-protein interactions: Hexon and protein VI. *J. Gen. Virol.*, 75: 3365-74 (1994).
Mayer et. al., Differentiation of osteogenetic cells: Systems and regulators, Z. Orthop., 130: 276-84 (1992)—Abstract Only.
McClung et. al., Inhibition of sclerostin with AMG 785 in postmenopausal women with low bone mineral density: Phase 2 trial results—Abstract presented at the 2012 meeting of the American Society for Bone and Mineral Reasearch (2012).
Memorandum C, Munich Diplomatic Conference, Sep. 1 to Oct. 6, 1973.
Minabe-Saegusa et. al., Genbank Sequence Database Accession No. AB011030, Jun. 23, 1998.
Minutes of the oral proceedings before the opposition division for Opposition against European Patent No. 1721979, dated May 10, 2013.
Miyazono et. al., Divergence and convergence of TGF-B/BMP signaling. *J. Cell. Physiol.*, 187:265-76 (2001).
Miyazono et. al., TGF-β signaling by Smad proteins. *Adv. Immunology*, 75:115-57 (2000).
Morais et. al., In vitro biomineralization by osteoblast-like cells I. Retardation of tissue mineralization by metal salts. *Biomaterials*, 19: 13-21 (1998).
Mori et. al., A novel amino acid substitution a the receptor-binding site on the hemaglutinin of H3N2 influenza A viruses isolated from 6 cases with acute encephalopathy during 1997-1998 season in Tokyo. *Arch. Virol.*, 144: 147-55 (1999).
Morrison et. al., ATP is a potent stimulator of the activiation and formation of rodent osteoclasts. *J. Physiol.*, 511.2: 495-500 (1998).
Mosekilde et. al., Assessing bone quality—Animcal models in preclinical osteoporosis research. *Bone*, 17 (4): 343S-52S (1995).
Moult, The current state of the art in protein structure predicion. *Curr. Opin. Biotech.*, 7(4):422-7 (1996).
Mullins et. al., Perspectives series: Molecular medicine in genetically engineered animals; Transgenesis in the rat and larger mammals. *J. Clin. Invest.*, 97(7):1557-60 (1996).
Muntoni et. al., A mutation in the dystrophin gene selectively affecting dystrophin expression in the heart. *J. Clin. Invest.*, 96: 693-9 (1995).
Nagaraja et. al., X chromosome map at 75-kb STS resolution, revealing extremes of recombination and GC content. *Genome Res.*, 7: 210-22 (1997).
Nakase et. al., Transient and localized expression of bone morphogenetic protein 4 messenger RNA during fracture healing. *J. Bone Miner. Res.*, 9(5):651-9 (1994).
Nelson, Positional cloning reaches maturity. *Curr. Opin. Genet. Devel.*, 5:298-303 (1995).

(56) References Cited

OTHER PUBLICATIONS

Nickel et. al., The crystal structure of the BMP-2: BMPR-1A complex and the generation of BMP-2 antagonists. *J. Bone Joint Surg.*, 83-A:S1-7-S1-14 (2001).
Nicolas et. al., An age-related decrease in the concentration of insulin-like growth factor binding protein-5 in human cortical bone. *Calcif. Tissue Int.*, 57:206-12 (1995).
Nifuji et. al., Coordinated expression of noggin and bone morphogenetic proteins (BMPs) during early skeletogenesi and induction of noggin expression by BMP-7. *J. Bone Miner. Res.*, 14(12):2057-66 (1999).
Niida et al., "DKK1, a negative regulator of Wnt signaling, is a target of the ß-catenin/TCF pathway," Oncogene, 23:8520-8526 (2004).
Nisonoff et. al., Separation of univalent fragments from the bivalent rabbit antidody molecule by reduction of disulfide bonds. *Arch. Biochem. Biophys.*, 89:230-44 (1960).
Niu et. al., Sclerostin inhibition leads to increased periosteal and endocortical bone formation as well as decreased cortical porosity in aged ovariectomized rats. *J. Bone Min. Res.*, 22(Suppl. S1) S65 (2007).
Nordsletten et. al., The neuronal regulation of fracture healing. *Acta Orthop Scand.*, 65(3): 299-304 (1994).
Notice of Opposition against European Patent No. 1133558, Opponent: Eli Lilly and Company, dated May 31, 2007.
Notice of Opposition against European Patent No. 1721979, Opponent: Eli Lilly & Company, dated Jun. 15, 2011.
Notice of Opposition against European Patent No. 1721979, Opponent: Laudens, dated Jun. 15, 2011.
Notice of Opposition against European Patent No. 1721979, Opponent: Novartis AG, dated Jun. 15, 2011.
Notice of Opposition to European Patent No. 1 133 558, dated May 29, 2007.
Nygren et. al., Scaffolds for engineering novel binding sites in proteins. *Curr. Opin. Struct. Biol.*, 7:463-9 (1997).
Observations of Opponent: Laudens in response to summons to oral proceedings in Opposition against European Patent No. 1721979, dated Feb. 25, 2013.
Oelgeschlager et. al., The evolutionarily conserved BMP-binding protein twisted gastrulation promotes BMP signalling. *Nature*, 405:757-63 (2000).
OMIM #607625, Niemann-pick disease, type C2 (2007).
Ominsky, et. al., Sclerostin monoclonal antibody treatment increases bone strength in aged osteopenic ovariectomozed rats. *J. Bone Min. Res.*, 21(1): S44 PRES1161 (2006). Abstract.
Opposition Decision for Opposition against European Patent No. 1721979, dated Aug. 2, 2013.
Opposition Statement of May 20, 2007 filed by Opponent 2 (Eli Lilly) against European Patent No. 1133558.
Oreffo et. al., Human bone marrow osteoprogenitors express estrogen receptor-alpha and bone morphogenetic proteins 2 and 4 mRNA during osteoblastic differentiation. *J. Cell. Biochem.*, 75:382-92 (1999).
Orriss et al., Purinergic signaling and bone remodeling. Curr. Opin. Pharmacol., 10:322-30 (2010).
Oshima et. al., TGF-β receeptor type II deficiency results in defects of yolk Sac hematopoiesis and vasculogenesis. *Dev. Biol.*, 179:297-302 (1996).
Padhi et. al., Anti-sclerostin antibody increases markers of bone formation in healthy postmenopausal women. *J. Bone Min. Res.*, 22: S37 (2007).
Padhi et. al., OC35—Effects of anti-sclerostin monoclonal antibody in healthy postmenopausal women. *Osteoporosis Int.*, 19: Suppl. 1: S19 (2008).
Padlan et. al., Structure of an antibody-antigen complex; Crystal structure of the HyHEL-10 Feb-lysozyme complex. *Proc. Natl. Acad. Sci. USA*, 86:5938-42 (1989).
Palokangas et. al., Endocytic pathway from the basal plasma membrane to the ruffled border membrane in bone-resorbing osteoclasts. *J. Cell Sci.*, 110: 1767-80 (1997).

Pandey et. al., Nucleotide sequence database: A gold mine for biologists. *TIBS.*, 24: 276-80 (1999).
Papapoulos et. al., Targeting sclerostin as potential treatment of osteoporosis. *Ann. Rheum. Dis.*, 70(Suppl. 1): I119-22 (2011).
Patel et. al., Current and potential future drug treatments for osteoporosis. *Ann. Rheumatic Dis.*, 55: 700-14 (1996).
Patten et. al., Applications of DNA shuffling to pharmaceuticals and vaccines. *Curr. Opin. Biotechnol.*, 8:724-33 (1997).
Pearson et. al., Effective protein sequence comparison. Chapter 15, pp. 227-258 (1996).
Piao et. al., The proximal promotor region of the gene encoding human 17β-hydroxysteroid dehydrogenase type 1 contains GATA, AP-2, and Sp1 response elements: Analysis of promotor function in choriocarcinoma cells. *Endrocrinol.*, 138(8): 3417-25 (1997).
Piccolo et. al., The head inducer Cerberus is a multifunctional antagonist of nodal, BMP and Wnt signals. *Nature*, 397: 707-10 (1999).
Piek et. al., Specificity, diversity, and regulation of TGF-B superfamily signaling. *FASEB J.*, 13:2105-24 (1999).
Pietromonaco et. al., Protein kinase C-Θ phosphorylation of moesin in the actin-binding sequence. *J. Biol. Chem.*, 273:7594-603 (1998).
Pignatti et. al., Tracking disease genes by reverse genetics. *J. Psychiar. Res.*, 26(4):287-98 (1992).
Pittenger et. al., Multilineage potential of adult human mesenchymal stem cells. *Science*, 284:143-7 (1999).
Pluckthun et. al., Expression of functional anitbody Fv and Fab fragments in *Escherichia coli*. *Meth. Enzymol.*, 178:497-515 (1989).
Pockwinse et. al., Expression of cell growth and bone specific genes at single cell resolution during development of bone tissue-like organization in primary osteoblast cultures. *J. Cell. Biol.*, 49:310-23 (1992).
Poole et. al., Sclerostin is a delayed secreted product of osteocytes that inhibit bone formation. *FESEB J.*, 19: 1842-4 (2005).
Porter, The hydrolysis of rabbit γ-globulin and antibodies with crystalline papain. *Biochem. J.*, 73:119-26 (1959).
Proprietor's Response to Opponent's Statement of Grounds of Appeal, European Patent No. 1133558, dated Apr. 15, 2010.
Proprietor's Response to Oppositions against European Patent No. 1721979, UCB Pharma S.A., dated Feb. 20, 2012.
Proprietor's Written submission in preparation for oral proceedings in Opposition against European Patent No. 1721979, Proprietor: UCB Pharma S.A., dated Feb. 25, 2013.
Quintanar-Guerrero et. al., Preparation techniques and mechanisms of formation of biodegradable nanoparticles from preformed polymers. *Drug Dev. Ind. Pharm.*, 24(12):1113-28 (1998).
Rachner et. al., Osteoporosis: Now and the future. *Lancet*, 377(9773): 1276-87 (2011).
Rawadi et. al., BMP-2 controls alkaline phosphatase expression and osteoblast mineralization by a Wnt autocrine loop. *J. Bone Min. Res.*, 18: 1842-53 (2003).
Reb, Antikorpergegen Sclerostin, *Medical Tribune*, 39:12 (2007).
Reddi et. al., The *Escherichia coli* chaperonin 60 (groEL) is a potent stimulator of osteoclast formation. *J. Bone Miner. Res.*, 13(8): 1260-6 (1998).
Reddi, Interplay between bone morphogenetic proteins and cognate binding proteins in bone and cartilage development: Noggin, chordin and DAN. *Arthritis Res.*, 3(1):1-5 (2000).
Reguart et al., "Cloning and characterization of the promoter of human Wnt inhibitory factor-1," Biochem Biophys Res Commun, 323:229-234 (2004).
Response to Proprietor's brief of Apr. 15, 2010, European Patent Opposition, EP-1133558 B1, dated Mar. 18, 2011.
Riggs, Overview of osteoporosis. *West J. Med.*, 154:63-77 (1991).
RnD Systems catalogue excerpt, cited in Opposition against European Patent No. 1721979 by Opponent: Novartis AG dated Jun. 15, 2011.
Roberts et. al., Essential functional interactions of SAFA, a *Saccharomyces cerevisiae* complex of Spt, Ada, and Gon5 proteins, with the Snf/Swi and Srb/Mediator complexes. *Genetics*, 147: 451-65 (1997).
Robinson et. al., The sclerostin antibody project. *Hum. Antibodies*, 16: 36 (2007).

(56) References Cited

OTHER PUBLICATIONS

Roitt et la., Roitt's Essential Immunology, 9th Edition, pp. 90-91 (1997).
Rosenzweig et. al., Cloning and characterization of a human type II receptor for bone morphogenetic proteins. *Proc. Natl. Acad. Sci. USA*, 92:7632-7636 (1995).
Rosenzweig et. al., GenBank Sequence Database Accession No. CAA88759, Oct. 7, 2008.
Rosenzweig et. al., GenBank Sequence Database Accession No. Z48923, Oct. 7, 2008.
Rudikoff, et. al., Single amino acid substitution altering antigen-binding specificity. *Proc. Natl. Acad. Sci. USA*, 79:1979-83 (1982).
Ruppert et. al., Human bone morphogenetic protein 2 contains a heparin-binding site which modifies its biological activity. *Eur. J. Biochem.*, 237: 295-302 (1996).
Sada et. al., Adsorption equilibirum in immuno-affinity chromatography with polyclonal and monoclonal antibodies. *Biotechnol. Bioengin.*, 28 (1986). Abstract.
Sali et. al., Comparative protein modeling by satisfaction of spatial restraints. *J. Mol. Biol.*, 234(3):779-815 (1993).
Sambrook et. al., Synthetic oligonucleotide probes, molecular cloning—A Laboratory Manual, Ch.11:11.1-11.19 and 11.58-11.61 (1989).
Sanger et. al., DNA sequencing with chain-terminating inhibitors. *Proc. Natl. Acad. Sci. USA*, 74:5463-7 (1997).
Sastry et. al., Cloning of the immunological repertoire in *Escherichia coli* for generation of monoclonal catalytic antibodies: Construction of a heavy chain variable region-specific cDNA library. *Proc. Natl. Acad. Sci. USA*, 86:5728-32 (1989).
Scatchard et. al., The attractions of proteins for small molecules and ions. *Ann. N.Y. Acad. Sci.*, 51:660-72 (1949).
Scheufler et. al., Crystal structure of human bone morphogenetic protein-2 at 2.7 A resolution. *J. Mol. Biol.*, 287(1):101-15 (1999).
Schlebusch et. al., Production of a single-chain fragment of the murine anti-idiotypic antibody ACA125 as phage-displayed and soluble antibody by recombinant phage antibody technique. *Hybridoma*, 16:47-52 (1997).
Schlunegger et. al., Refined crystal structure of human transforming growth factor β2 at 1.95 A Resolution. *J. Mol. Biol.*, 231(2):445-458 (1993).
Schmidt et. al., Retrovirus-induced osteopetrosis in mice: Effects of viral infection on osteogenic differentiation in skeletoblast cell cultures. *Am. J. Pathol.*, 129(3): 503-10 (1987).
Schmitt et. al., Bone morphogenetic proteins: An update on basic biology and clinical relevance. *J. Orth. Res.*, 17:269-78 (1999).
Schwappacher et. al., NCBI Sequence Database Accession No. NM_001204, Aug. 16, 2009.
Scully et. al., BRCA1 is a component of the RNA polymerase II holoenzyme. *Proc. Natl. Acad. Sci. USA*, 94: 5605-10 (1997).
Second declaration of Martyn Robinson, citation in Appeal, European Patent No. 1133558, dated Apr. 15, 2010.
Serra et. al., Expression of a truncated, kinase-defective TGF-β type II receptor in mouse skeletal tissue promotes terminal chondrocyte differentiation and osteoarthritis. *J. Cell. Biol.*, 139(2):541-52 (1997).
Sigmund, Viewpoint: Are studies in genetically altered mice out of control? *Arterioscler. Thromb. Vasc.* Biol., 20:1425-9 (2000).
Silverman et. al., Sclerostin, *J. Osteoporosis*, 2010: 1-3 (2010).
Sippl et. al., Threading thrills and threats. *Structure*, 4(1):15-19 (1996).
Siris, Clinical Review: Paget's disease of bone. *J. Bone Miner. Res.*, 13(7): 1061-5 (1998).
Sivakumar et. al., New insights into extracellular matrix assembly and reorganization from dynamic imaging of extracellular matrix proteins in living osteoblasts. *J. Cell. Sci.*, 119(7):1350-60 (2006).
Skiple Skjerpen et. al., Binding of FGF-1 variants to protein kinase CK2 correlates with mitogenicity. *EMBO J.*, 21(15): 4058-69 (2002).
Slater et. al., Involvement of platelets in stimulating osteogenic activity. J. Orthopaedic Res., 13: 655-63 (1995).
Smith et. al., Glucocorticoids inhibit development stage-specific osteoblast cell cycle. *J. Biol. Chem.*, 275:19992-20001 (2000).

Smith, TGF β inhibitors, new and unexpected requirements in vertebrate development. *TIG*, 15(1):3-5 (1999).
Sohocki et. al., A range of clinical phenotypes associated with mutations in CRX, a photoreceptor transcription-factor gene. *Am. J. Hum. Genet.*, 63: 1307-15 (1998).
Spranger, International classification of osteochondrodysplasias, *Eur. J. Pediatr.*, 151: 407-15 (1992).
Staehling-Hampton et. al., A 52-kb delection in the SOST-MEOX1 intergenic region on 17q12-q21 is associated with van Buchem disease in the Dutch population. *Am. J. Med. Gen.*, 110: 144-52 (2002).
Stanley et. al., DAN is a secreted glycopeotein related to Xenopus cerberus. *Mech. Dev.*, 77: 173-84 (1998).
Statement of Grounds of Appeal to Decision of Opposition against European Patent No. 1133558, dated Sep. 28, 2009.
Stenmark et. al., Distinct structural elements of rab5 define its functional specificity. *EMBO J.*, 13(3): 575-83 (1994).
Strachan et. al. (Eds.), Diagram from text book entitled Human Molecular Genetics, 2nd Edition (1999).
Strachan et. al. (Eds.), Human Molecular Genetics, 1st Edition, p. 420 (1996).
Strachan et. al., (Eds.), Human Molecular Genetics, 2nd Edition, Figure 15.4 (1999).
Submission in response to oral proceedings in Opposition against European Patent No. 1721979, Opponent: Eli Lilly, dated Apr. 24, 2013.
Sudo et. al., In vitro differentiation and calcification in a new clonal osteogenic cell line derived from newborn mouse calvaria. *J. Cell Biol.*, 96:191-8 (1983).
Summons to attend oral proceedings for Opposition against European Patent No. 1133558, dated Nov. 4, 2008.
Summons to attend oral proceedings in Opposition against European Patent No. 1721979, dated Nov. 12, 2012.
Sutherland et. al., Sclerostin romotes the apoptosis of human osteoblastic cells: A novel regulation of bone formation. *Bone*, 35:828-35 (2004).
Suzawa et. al., Extracellular matrix-associated bone morphogenetic proteins are essential for differentiation of murine osteoblastic cells in vitro. *Endocrinology*, 140:2125-33 (1999).
Sverdlov et. al., Perpetually mobile footprints of ancient infections in human genome. FEBS Lett., 428: 1-6 (1998).
Sylatron label, cited in Opposition against European Patent No. 1721979 by Opponent: Novartis AG, dated Jun. 15, 2011.
Takakura, Drug delivery systems in gene therapy. *Nippon Rinsho*, 56(3):691-5 (1998) (Abstract Only).
Takeda et. al., GenBank Sequence Database Accession No. AAB33865, May 27, 1995.
Takeda et. al., GenBank Sequence Database Accession No. D38082, dated Dec. 27, 2006.
Takeda et. al., GenBank Sequence Database Accession No. S75359, May 27, 1995.
Takeda et. al., NCBI Sequence Database Accession No. NM_030849, Feb. 11, 2009.
Takeda, Expression of serine/threonine kinase receptors during ectopic bone formation induced by bone morphogenetic protein (BMP). *Kokubyo Gakkai Zasshi*, 61(4):512-26 (1994).
Tam et. al., TGF-β receptor expression on human keratinocytes: A 150 kDa GPI-anchored TGF-β1 binding protein forms a heteromeric complex with type I and type II receptors. *J. Cellular Biochem.*, 70:573-56 (1998).
Taylor et. al., Human immunoglobulin transgenes undergo rearrangement, somatic mutation and class switching in mice that lack endogenous IgM. *Int. Immun.*, 6:579 (1994).
The Merck Manual-Second Home Edition, Ch. 61:1-3 (2005).
Thompson et. al., Affinity maturation of a high-affinity human monoclonal antibody against the third hypervariable loop of human immunodeficiency virus: Use of phage display to improve affinity and broaden strain reactivity. *J. Mol. Biol.*, 256:7-88 (1996).
Thornton et. al., Prediction of progress at last. *Nature*, 354:105-6 (1991).
Tjaderhane et. al., A high sucrose diet decreases the mechanical strength of bones in growing rats. *J. Nutr.*, 128: 1807-10 (1998).

(56) References Cited

OTHER PUBLICATIONS

Tuncay et. al., Oxygen tension regulates osteoblast function. *Am. J. Orthod. Dentofac. Orthop.*, 105: 457-63 (1994).
UCB and Amgen announce positive phase 2 results of CDP7851/AMG785 in patients with post menopausal osteoporosis (PMO), dated Apr. 21, 2011—Citation in Opposition against European Patent No. 1721979.
Uitterlinden et. al., Relation of alleles of the collagen type Iα1 gene to bone density and the risk of osteoporotic fractures in postmenopausal women. *New Engl. J. Med.*, 338: 1016-21 (1998).
Utting et al., Hypoxia stimulates osteoclast formation from human peripheral blood. *Cell Biochem. Funct.*, 28:374-80 (2010).
Valero et. al., Quaternary structure of casein kinase 2. *J. Biol. Chem.*, 27(14): 8345-52 (1995).
Van Bezooijen et. al., Sclerostin is an osteocyte-expressed negative regulator of bone formation, but not a classical BMP antagonist. *J. Exp. Med.*, 199: 805-14 (2004).
Van Bezooijen et. al., SOST/sclerostin, an osteocyte-derived negative regulator of bone formation, *Cytokine Growth Factor Rev.*, 16: 319-27 (2005).
Van Bezooijen et. al., Wnt but not BMP signaling is involved in the inhibitory action of sclerostin on BMP-stimulated bone formation. *J. Bone. Miner. Res.*, 22:19-28 (2007).
Van Hul et. al., Van Buchem Disease (hyperostosis corticalis generalisata) maps to chromosome 17q12-a21. *Am. J. Hum. Genet.*, 2:391-9 (1998).
Vanier et. al., Recent advances in elucidating Niemann-Pick C disease. *Brain Pathol.*, 8: 163-74 (1998).
Veverka et. al., Characterization of the structural features and interactions of sclerostin. *J. Biol. Chem.*, 284(16): 10890-900 (2009).
Viter et. al., Analysis of antigenic structure of potato virus M Ukrainian strains. *Biopolimery I Kletka, Naukova Dumka, Kiev K, UK*, 16: 312-9 (2000).
Von Bubnoff et. al., Intracellular BMP signaling regulation in vertebrates: Pathway or network? *Dev. Biol.*, 239:1-14 (2001).
Wall, Transgenic livestock: Progress and prospects for the future. *Theriogenology*, 45:57-68 (1996).
Wang et. al., IFP 35 forms complexes with B-ATF, a member of the AP1 family of transcription factors. *Biochem. Biophys. Res. Commun.*, 229: 316-22 (1996).
Wang, Bone morphogenetic proteins (BMPs): Therapeutic potential in healing bony defects. *TIBTECH*, 11:379-83 (1993).
Warmington et. al., Sclerostin antagonism in adult rodents, via monoclonal antibody mediated blockade, increases bone mineral density and implicates sclerostia as a key regulator of bone mass during adulthood. *J. Bone Min. Res.*, 19:S56-7 (2004).
Warmington et. al., Sclerostin monoclonal antibody treatment of osteoporotic rats completely reverses one year of overiectomy-induced systemic bone loss, *J. Bone Min. Res.*, 20:S22 (2005).
Winkler et. al., Noggin and sclerostin bone morphogenetic protein antagonists form a mutually inhibitory complex. *J. Biol. Chem.*, 279(35): 36296-8 (2004).
Winkler et. al., Osteocyte control of bone formation via sclerostin, a novel BMP antagonist. *EMBO J.* 22: 6267-76 (2003).
Winkler et. al., Sclerostin inhibition of Wnt-3a-induced C3H10T1/2 cell differentiation is indirect and mediated by bone morphogenetic proteins. *J. Biol. Chem.* 280: 2498-502 (2005).

Winter et. al., Making antibodies by phase display technology. *Annu. Rev. Immunol.*, 12:433-55 (1994).
Wolff et. al., Monoclonal antibody homodimers: Enhanced antitumor activity in nude mice. *Cancer Res.*, 53:2560-5 (1993).
Wollenberger et. al. (Eds.), Analytische Biochemie, Chapter 3, pp. 47-49 (2003).
Written submission—Observation by a Third Party According to Art. 115 EPC, Opposition to European Patent No. 1133558, dated Nov. 25, 2008.
Written submission in response to summons to oral proceedings in Opposition against European Patent No. 1721979, Opponent: Eli Lilly Company, dated Feb. 25, 2013.
Written submission in response to summons to oral proceedings in Opposition against European Patent No. 1721979, Opponent: Norvartis AG, dated Feb. 25, 2013.
Written submission of Eli Lilly & Company to European Patent Office, Opposition to European Patent No. 1133558, dated May 29, 2007.
Written Submission of Eli Lilly & Company, Opposition to European Patent No. 1133558, dated Mar. 9, 2009.
Written submission of UCB S.A., Proprietor's Preliminary Response to the Opponent's submission of Mar. 9, 2009, Opposition to European Patent No. 1133558, dated Mar. 20, 2009.
Written submission of UCB S.A., Proprietor's Response to Opposition against European Patent No. 1133558, dated Mar. 14, 2008.
Yanagita et. al., USAG-1: A bone morphogenetic protein antagonist abundantly expressed in the kidney. *Biochem. Biophys. Res. Comm.*, 316: 490-550 (2004).
Yang et. al., CDR walking mutagenesis for the affinity maturation of a potent human Anti-HIV-1 antibody into the picomolar range. *J. Mol. Biol.*, 254:392-403 (1995).
Yates et. al., Inhibition of bone resorption by inorganic phosphate in mediated by both reduced osteoclast formation and decreased activity of mature osteoclasts. *J. Bone Miner. Res.*, 6(5): 476-8 (1990).
Yerges et. al., NCBI Sequence Database Accession No. NM_001203, Jul. 12, 2009.
Yerges et. al., NCBI Sequence Database Accession No. NP_001194, Jul. 12, 2009.
Yoshida et. al., Osteoinduction capability of recombinant human bone morphogenetic protein-2 in intramuscular and subcutaneous sites: An experimental study. *J. Cranio-Maxillofac. Surg.*, 26: 112-5 (1998).
Zambaux et. al., Influence of experimental parameters on the characteristics of poly(lactic acid) nanoparticles prepared by a double emulsion method. *J. Controlled Rel.*, 50(1-3):31-40 (1998).
Zhang et. al., Humanization of an anti-human TNF-β antibody by variable region resurfacing with the aid of molecular modeling. *Molec. Immunol.*, 42(12):1445-51 (2005).
Zimmerman et. al., The spemann organizer signal noggin binds and inactives bone morphogenetic protein 4. *Cell*, 86(4):599-606 (1996).
Zlotogora et. al., Dominance and homozygosity, *Am. J. Med. Genet.*, 68: 412-6 (1997).
Zur Muhlen et. al., Solid lipid nanoparticles (SLN) for controlled drug delivery—Drug release and release mechanism. *Eur. J. Pharm. Biopharm.*, 45(2):149-55 (1998).

\* cited by examiner

FIGURE 10

| Sequence Description | Sequence |
|---|---|
| Ab-A and Ab-1 CDR-L1 | QSSQSVYDNNWLA (SEQ ID NO: 54) |
| Ab-A and Ab-1 CDR-L2 | DASDLAS (SEQ ID NO: 55) |
| Ab-A and Ab-1 CDR-L3 | QGAYNDVIYA (SEQ ID NO: 56) |
| Ab-A and Ab-1 CDR-H1 | SYWMN (SEQ ID NO: 51) |
| Ab-A and Ab-1 CDR-H2 | TIDSGGRTDYASWAKG (SEQ ID NO: 52) |
| Ab-A and Ab-1 CDR-H3 | NWNL (SEQ ID NO: 53) |
| Ab-A light chain | SEQ ID NO: 23 |
| Ab-A heavy chain | SEQ ID NO: 27 |
| Ab-1 light variable region (with signal sequence) | SEQ ID NO: 75 |
| Ab-1 heavy variable region (with signal sequence) | SEQ ID NO: 77 |
| Ab-B CDR-L1 | SASSSVSFVD (SEQ ID NO: 60) |
| Ab-B CDR-L2 | RTSNLGF (SEQ ID NO: 61) |
| Ab-B CDR-L3 | QQRSTYPPT (SEQ ID NO: 62) |
| Ab-B CDR-H1 | TSGMGVG (SEQ ID NO: 57) |
| Ab-B CDR-H2 | HIWWDDVKRYNPVLKS (SEQ ID NO: 58) |
| Ab-B CDR-H3 | EDFDYDEEYYAMDY (SEQ ID NO: 59) |
| Ab-B light chain | SEQ ID NO: 31 |
| Ab-B heavy chain | SEQ ID NO: 35 |
| Ab-C CDR-L1 | KASQSVDYDGDSYMN (SEQ ID NO: 48) |
| Ab-C CDR-L2 | AASNLES (SEQ ID NO: 49) |
| Ab-C CDR-L3 | QQSNEDPWT (SEQ ID NO: 50) |
| Ab-C CDR-H1 | DCYMN (SEQ ID NO: 45) |
| Ab-C CDR-H2 | DINPFNGGTTYNQKFKG (SEQ ID NO: 46) |
| Ab-C CDR-H3 | SHYYFDGRVPWDAMDY (SEQ ID NO: 47) |
| Ab-C light chain | SEQ ID NO: 15 |
| Ab-C heavy chain | SEQ ID NO: 19 |
| Ab-D CDR-L1 | QASQGTSINLN (SEQ ID NO: 42) |
| Ab-D CDR-L2 | GSSNLED (SEQ ID NO: 43) |
| Ab-D CDR-L3 | LQHSYLPYT (SEQ ID NO: 44) |
| Ab-D CDR-H1 | DHYMS (SEQ ID NO: 39) |
| Ab-D CDR-H2 | DINPYSGETTYNQKFKG (SEQ ID NO: 40) |
| Ab-D CDR-H3 | DDYDASPFAY (SEQ ID NO: 41) |
| Ab-D light chain | SEQ ID NO: 7 |
| Ab-D heavy chain | SEQ ID NO: 11 |
| Ab-2 CDR-L1 | RASSSVYYYMH (SEQ ID NO: 275) |
| Ab-2 CDR-L2 | ATSNLAS (SEQ ID NO: 276) |
| Ab-2 CDR-L3 | QQWSSDPLT (SEQ ID NO: 277) |
| Ab-2 CDR-H1 | DYFIH (SEQ ID NO: 287) |
| Ab-2 CDR-H2 | RLDPEDGESDYAPKFQD (SEQ ID NO: 288) |
| Ab-2 CDR-H3 | EDYDGTYTFFPY (SEQ ID NO: 289) |
| Ab-2 light chain | SEQ ID NO: 117 |
| Ab-2 heavy chain | SEQ ID NO: 121 |
| Ab-3 and Ab-15 CDR-L1 | SVSSTISSNHLH (SEQ ID NO: 278) |

FIGURE 10 (cont.)

| Sequence Description | Sequence |
|---|---|
| Ab-3 and Ab-15 CDR-L2 | GTSNLAS (SEQ ID NO: 279) |
| Ab-3 and Ab-15 CDR-L3 | QQWSSYPLT (SEQ ID NO: 280) |
| Ab-3 and Ab-15 CDR-H1 | DFYLH (SEQ ID NO: 290) |
| Ab-3 and Ab-15 CDR-H2 | RIDPENGDTLYDPKFQD (SEQ ID NO: 291) |
| Ab-3 and Ab-15 CDR-H3 | EADYFHDGTSYWYFDV (SEQ ID NO: 292) |
| Ab-3 light chain | SEQ ID NO: 125 |
| Ab-3 heavy chain | SEQ ID NO: 129 |
| Ab-15 light variable region | SEQ ID NO: 384 |
| Ab-15 heavy variable region | SEQ ID NO: 386 |
| Ab-15 light chain | SEQ ID NO: 221 |
| AB-15 heavy chain | SEQ ID NO: 225 |
| Ab-4 and Ab-5 CDR-L1 | RASQDISNYLN (SEQ ID NO: 78) |
| Ab-4 and Ab-5 CDR-L2 | YTSRLLS (SEQ ID NO: 79) |
| Ab-4 and Ab-5 CDR-L3 | QQGDTLPYT (SEQ ID NO: 80) |
| Ab-4 and Ab-5 CDR-H1 | DYNMH (SEQ ID NO: 245) |
| Ab-4 and Ab-5 CDR-H2 | EINPNSGGAGYNQKFKG (SEQ ID NO: 246) |
| Ab-4 and Ab-5 CDR-H3 | LGYDDIYDDWYFDV (SEQ ID NO: 247) |
| Ab-4 light chain | SEQ ID NO: 133 |
| Ab-4 heavy chain | SEQ ID NO: 137 |
| Ab-5 light variable region | SEQ ID NO: 376 |
| Ab-5 heavy variable region | SEQ ID NO: 378 |
| Ab-5 light chain | SEQ ID NO: 141 |
| Ab-5 heavy chain | SEQ ID NO: 145 |
| Ab-6 CDR-L1 | RASQDISNYLN (SEQ ID NO: 81) |
| Ab-6 CDR-L2 | YTSRLHS (SEQ ID NO: 99) |
| Ab-6 CDR-L3 | QQGDTLPYT (SEQ ID NO: 100) |
| Ab-6 CDR-H1 | DYNMH (SEQ ID NO: 248) |
| Ab-6 CDR-H2 | EINPNSGGSGYNQKFKG (SEQ ID NO: 249) |
| Ab-6 CDR-H3 | LVYDGSYEDWYFDV (SEQ ID NO: 250) |
| Ab-6 light chain | SEQ ID NO: 149 |
| Ab-6 heavy chain | SEQ ID NO: 153 |
| Ab-7 CDR-L1 | RASQVITNYLY (SEQ ID NO: 101) |
| Ab-7 CDR-L2 | YTSRLHS (SEQ ID NO: 102) |
| Ab-7 CDR-L3 | QQGDTLPYT (SEQ ID NO: 103) |
| Ab-7 CDR-H1 | DYNMH (SEQ ID NO: 251) |
| Ab-7 CDR-H2 | EINPNSGGAGYNQQFKG (SEQ ID NO: 252) |
| Ab-7 CDR-H3 | LGYVGNYEDWYFDV (SEQ ID NO: 253) |
| Ab-7 light chain | SEQ ID NO: 157 |
| Ab-7 heavy chain | SEQ ID NO: 161 |
| Ab-8 CDR-L1 | RASQDISNYLN (SEQ ID NO: 104) |
| Ab-8 CDR-L2 | YTSRLLS (SEQ ID NO: 105) |
| Ab-8 CDR-L3 | QQGDTLPYT (SEQ ID NO: 106) |
| Ab-8 CDR-H1 | DYNMH (SEQ ID NO: 254) |
| Ab-8 CDR-H2 | EINPNSGGAGYNQKFKG (SEQ ID NO: 255) |
| Ab-8 CDR-H3 | LGYDDIYDDWYFDV (SEQ ID NO: 256) |

FIGURE 10 (cont.)

| Sequence Description | Sequence |
|---|---|
| Ab-8 light chain | SEQ ID NO: 165 |
| Ab-8 heavy chain | SEQ ID NO: 169 |
| Ab-9 CDR-L1 | RASQDISNYLN (SEQ ID NO: 107) |
| Ab-9 CDR-L2 | YTSRLFS (SEQ ID NO: 108) |
| Ab-9 CDR-L3 | QQGDTLPYT (SEQ ID NO: 109) |
| Ab-9 CDR-H1 | DYNMH (SEQ ID NO: 257) |
| Ab-9 CDR-H2 | EINPNSGGAGYNQKFKG (SEQ ID NO: 258) |
| Ab-9 CDR-H3 | LGYDDIYDDWYFDV (SEQ ID NO: 259) |
| Ab-9 light chain | SEQ ID NO: 173 |
| Ab-9 heavy chain | SEQ ID NO: 177 |
| Ab-10 CDR-L1 | RASQDISNYLN (SEQ ID NO: 110) |
| Ab-10 CDR-L2 | YTSRLLS (SEQ ID NO: 111) |
| Ab-10 CDR-L3 | QQGDTLPYT (SEQ ID NO: 112) |
| Ab-10 CDR-H1 | DYNMH (SEQ ID NO: 260) |
| Ab-10 CDR-H2 | EINPNSGGAGYNQKFKG (SEQ ID NO: 261) |
| Ab-10 CDR-H3 | LGYDDIYDDWYFDV (SEQ ID NO: 262) |
| Ab-10 light chain | SEQ ID NO: 181 |
| Ab-10 heavy chain | SEQ ID NO: 185 |
| Ab-11 and Ab-16 CDR-L1 | RASSSISYIH (SEQ ID NO: 281) |
| Ab-11 and Ab-16 CDR-L2 | ATSNLAS (SEQ ID NO: 282) |
| Ab-11 and Ab-16 CDR-L3 | QQWSSDPLT (SEQ ID NO: 283) |
| Ab-11 and Ab-16 CDR-H1 | DYYIH (SEQ ID NO: 293) |
| Ab-11 and Ab-16 CDR-H2 | RVDPDNGETEFAPKFPG (SEQ ID NO: 294) |
| Ab-11 and Ab-16 CDR-H3 | EDYDGTYTWFPY (SEQ ID NO: 295) |
| Ab-11 light chain | SEQ ID NO: 189 |
| Ab-11 heavy chain | SEQ ID NO: 193 |
| Ab-16 light variable region | SEQ ID NO: 388 |
| Ab-16 heavy variable region | SEQ ID NO: 390 |
| Ab-16 light chain | SEQ ID NO: 229 |
| Ab-16 heavy chain | SEQ ID NO: 233 |
| Ab-12 CDR-L1 | RASQDISNYLN (SEQ ID NO: 113) |
| Ab-12 CDR-L2 | YTSTLQS (SEQ ID NO: 114) |
| Ab-12 CDR-L3 | QQGDTLPYT (SEQ ID NO: 115) |
| Ab-12 CDR-H1 | DYNMH (SEQ ID NO: 263) |
| Ab-12 CDR-H2 | EINPNSGGSGYNQKFKG (SEQ ID NO: 264) |
| Ab-12 CDR-H3 | LGYYGNYEDWYFDV (SEQ ID NO: 265) |
| Ab-12 light chain | SEQ ID NO: 197 |
| Ab-12 heavy chain | SEQ ID NO: 201 |
| Ab-13 and Ab-14 CDR-L1 | RASSSVTSSYLN (SEQ ID NO: 284) |
| Ab-13 and Ab-14 CDR-L2 | STSNLAS (SEQ ID NO: 285) |
| Ab-13 and Ab-14 CDR-L3 | QQYDFFPST (SEQ ID NO: 286) |
| Ab-13 and Ab-14 CDR-H1 | DYYMN (SEQ ID NO: 296) |
| Ab-13 and Ab-14 CDR-H2 | DINPYNDDTTYNHKFKG (SEQ ID NO: 297) |
| Ab-13 and Ab-14 CDR-H3 | ETAVITTNAMD (SEQ ID NO: 298) |
| Ab-13 light chain | SEQ ID NO: 205 |

FIGURE 10 (cont.)

| Sequence Description | Sequence |
|---|---|
| Ab-13 heavy chain | SEQ ID NO: 209 |
| Ab-14 light variable region | SEQ ID NO: 380 |
| Ab-14 heavy variable region | SEQ ID NO: 382 |
| Ab-14 light chain | SEQ ID NO: 213 |
| Ab-14 heavy chain | SEQ ID NO: 217 |
| Ab-17 and Ab-18 CDR-L1 | SVSSSISSSNLH (SEQ ID NO: 116) |
| Ab-17 and Ab-18 CDR-L2 | GTSNLAS (SEQ ID NO: 237) |
| Ab-17 and Ab-18 CDR-L3 | QQWTTTYT (SEQ ID NO: 238) |
| Ab-17 and Ab-18 CDR-H1 | DYYIH (SEQ ID NO: 266) |
| Ab-17 and Ab-18 CDR-H2 | RIDPDNGESTYVPKFQG (SEQ ID NO: 267) |
| Ab-17 and Ab-18 CDR-H3 | EGLDYGDYYAVDY (SEQ ID NO: 268) |
| Ab-17 light variable region (with signal sequence) | SEQ ID NO: 299 |
| Ab-17 heavy variable region (with signal sequence) | SEQ ID NO: 301 |
| Ab-18 light variable region (with signal sequence) | SEQ ID NO: 303 |
| Ab-18 heavy variable region (with signal sequence) | SEQ ID NO: 305 |
| Ab-19, Ab-20 and Ab-23 CDR-L1 | RASQDISSYLN (SEQ ID NO: 239) |
| Ab-19, Ab-20 and Ab-23 CDR-L2 | STSRLNS (SEQ ID NO: 240) |
| Ab-19, Ab-20 and Ab-23 CDR-L3 | QQDIKHPT (SEQ ID NO: 241) |
| Ab-19, Ab-20 and Ab-23 CDR-H1 | DYIMH (SEQ ID NO: 269) |
| Ab-19, Ab-20 and Ab-23 CDR-H2 | YINPYNDDTEYNEKFKG (SEQ ID NO: 270) |
| Ab-19, Ab-20 and Ab-23 CDR-H3 | SIYYYDAPFAY (SEQ ID NO: 271) |
| Ab-19 light variable region | SEQ ID NO: 314 |
| Ab-19 heavy variable region | SEQ ID NO: 327 |
| Ab-19 light chain (with signal sequence) | SEQ ID NO: 307 |
| Ab-19 heavy chain (with signal sequence) | SEQ ID NO: 309 |
| Ab-20 light variable region (with signal sequence) | SEQ ID NO: 311 |
| Ab-20 heavy variable region (with signal sequence) | SEQ ID NO: 313 |
| Ab-23 light variable region | SEQ ID NO: 364 |
| Ab-23 heavy variable region | SEQ ID NO: 366 |
| Ab-23 light chain | SEQ ID NO: 341 |
| Ab-23 heavy chain | SEQ ID NO: 345 |
| Ab-21 and Ab-22 CDR-L1 | KASQDVFTAVA (SEQ ID NO: 242) |
| Ab-21 and Ab-22 CDR-L2 | WASTRHT (SEQ ID NO: 243) |
| Ab-21 and Ab-22 CDR-L3 | QQYSSYPLT (SEQ ID NO: 244) |
| Ab-21 and Ab-22 CDR-H1 | DYYMH (SEQ ID NO: 272) |
| Ab-21 and Ab-22 CDR-H2 | RIDPENGDIIYDPKFQG (SEQ ID NO: 273) |
| Ab-21 and Ab-22 CDR-H3 | DAGDPAWFTY (SEQ ID NO: 274) |
| Ab-21 light variable region (with signal sequence) | SEQ ID NO: 315 |
| Ab-21 heavy variable region (with signal | SEQ ID NO: 317 |

FIGURE 10 (cont.)

| Sequence Description | Sequence |
|---|---|
| sequence) | |
| Ab-22 light variable region | SEQ ID NO: 368 |
| Ab-22 heavy variable region | SEQ ID NO: 370 |
| Ab-24 CDR-L1 | KASQSVDYDGTSYMN (SEQ ID NO: 351) |
| Ab-24 CDR-L2 | AASNLES (SEQ ID NO: 352) |
| Ab-24 CDR-L3 | QQSNEDPFT (SEQ ID NO: 353) |
| Ab-24 CDR-H1 | TYWMN (SEQ ID NO: 358) |
| Ab-24 CDR-H2 | MIHPSASEIRLDQKFKD (SEQ ID NO: 359) |
| Ab-24 CDR-H3 | SGEWGSMDY (SEQ ID NO: 360) |
| Ab-24 light chain | SEQ ID NO: 350 |
| Ab-24 heavy chain | SEQ ID NO: 357 |

# ANTI-SCLEROSTIN ANTIBODIES AND THEIR USE TO TREAT BONE DISORDERS AS PART OF A REGIMEN

INCORPORATION BY REFERENCE

The following applications are hereby incorporated by reference in their entirety: U.S. patent application Ser. No. 11/410,540, filed Apr. 25, 2006, which claims priority to U.S. Provisional Patent Application No. 60/792,645, filed Apr. 17, 2006, U.S. Provisional Patent Application No. 60/782,244, filed Mar. 13, 2006, U.S. Provisional Patent Application No. 60/776,847, filed Feb. 24, 2006, and U.S. Provisional Patent Application No. 60/677,583, filed May 3, 2005; and U.S. patent application Ser. No. 11/411,003 (issued as U.S. Pat. No. 7,592,429), filed Apr. 25, 2006, which claims priority to U.S. Provisional Patent Application No. 60/792,645, filed Apr. 17, 2006, U.S. Provisional Patent Application No. 60/782,244, filed Mar. 13, 2006, U.S. Provisional Patent Application No. 60/776,847, filed Feb. 24, 2006, and U.S. Provisional Patent Application No. 60/677,583, filed May 3, 2005. The following applications also are hereby incorporated by reference: U.S. Provisional Patent Application No. 61/668,210, filed Jul. 5, 2012; U.S. patent application Ser. No. 12/212,327, filed Sep. 17, 2008, which claims priority to U.S. Provisional Patent Application No. 60/973,024, filed Sep. 17, 2007; and U.S. patent application Ser. No. 12/811,171, filed Jun. 29, 2010, which is a U.S. National Phase Application pursuant to 35 U.S.C. § 371 of International Patent Application No. PCT/US08/86864, filed on Dec. 15, 2008, which claims priority to U.S. Provisional Patent Application No. 61/013,917, filed Dec. 14, 2007. U.S. Patent Application No. 61/668,210, filed 5 Jul. 2012. U.S. Patent Application No. 61/782,072, filed 14 Mar. 2013. U.S. patent application Ser. No. 13/934,433 filed 3 Jul. 2013.

TECHNICAL FIELD OF THE INVENTION

The invention relates to treating bone disorders using sclerostin antibodies.

BACKGROUND OF THE INVENTION

Loss of bone mineral content can be caused by a wide variety of conditions and may result in significant medical problems. For example, osteoporosis is a debilitating disease in humans and is characterized by marked decreases in skeletal bone mass and mineral density, structural deterioration of bone, including degradation of bone microarchitecture and corresponding increases in bone fragility (i.e., decreases in bone strength), and susceptibility to fracture in afflicted individuals. Osteoporosis in humans is generally preceded by clinical osteopenia (bone mineral density that is greater than one standard deviation but less than 2.5 standard deviations below the mean value for young adult bone), a condition found in approximately 25 million people in the United States. Another 7-8 million patients in the United States have been diagnosed with clinical osteoporosis (defined as bone mineral content greater than 2.5 standard deviations below that of mature young adult bone). The frequency of osteoporosis in the human population increases with age. Among Caucasians, osteoporosis is predominant in women who, in the United States, comprise 80% of the osteoporosis patient pool. The increased fragility and susceptibility to fracture of skeletal bone in the aged is aggravated by the greater risk of accidental falls in this population. Fractured hips, wrists, and vertebrae are among the most common injuries associated with osteoporosis. Hip fractures in particular are extremely uncomfortable and expensive for the patient, and for women correlate with high rates of mortality and morbidity.

SUMMARY OF THE INVENTION

The following summary is not intended to define every aspect of the invention, and additional aspects are described in other sections, such as the Detailed Description. The entire document is intended to be related as a unified disclosure, and it should be understood that all combinations of features described herein are contemplated, even if the combination of features are not found together in the same sentence, or paragraph, or section of this document. With respect to aspects of the invention described or claimed with "a" or "an", it should be understood that these terms mean "one or more" unless context unambiguously requires a more restricted meaning. The term "or" should be understood to encompass items in the alternative or together, unless context unambiguously requires otherwise. If aspects of the invention are described as "comprising" a feature, embodiments also are contemplated "consisting of" or "consisting essentially of" the feature. Where the term "about" is used the application also discloses employing the exact value specified. Where point values are referred to, the application also discloses about such values being employed, the same being the case for endpoints of ranges.

Antibodies against sclerostin may be used to treat bone disorders, as they both promote bone formation and inhibit bone resorption. It has now been found that a regimen comprising a high initial loading dose or doses of sclerostin antibody, followed by subsequent lower doses of the antibody, is effective with a number of advantages. The approach typically allows for a rapid burst of bone formation, followed by a slower rate of bone formation. In a preferred instance, the approach may be used to help treat subjects who are particularly at risk, including those most recently diagnosed with a bone disorder, those experiencing a loss of bone density and/or those with a recent bone fracture, where a rapid initial burst of bone formation and/or rapid increase in bone density may help. For instance, the rapid increase in bone formation and/or increase in bone density may help the subject avoid future fractures. The subsequent lower doses of sclerostin antibodies then help maintain the increased bone formation and/or increased bone density and more slowly add to it. Hence, the invention provides via the loading dose approach a way to provide a rapid burst of bone formation when it is most needed, then helps maintain the bone generated and more slowly add to it in a controlled fashion.

In a further preferred instance, the frequency of dosing with sclerostin antibody may be altered. For instance, a further way to have a fast initial rapid rate of bone formation and then a more controlled lower rate of bone formation is to decrease the dosing frequency for the sclerostin antibody during the treatment. Hence, in one instance, the subject is given at least two initial doses and then at least one subsequent dose, where the interval between the initial doses is smaller than that between either, or both, of the interval between the at least two initial doses and the subsequent dose or the interval between the subsequent doses where more than one dose is administered. Such a dosing frequency approach may be employed as an alternative to a loading dose or in combination with the loading dose approach. Hence, it may be that the initial and subsequent doses in the dosing frequency approach are the same, or at least approximately equivalent, or it may be that at least some of the initial doses before the switch to lower dosing frequency are higher and may be loading dose(s). Any of the descriptions herein of the dosing frequency approach may therefore be used as alternative or in combination with the loading dose approach also described herein.

In a preferred embodiment, the loading dose approach or dosing frequency approach is employed in conjunction with a dosing holiday. In one instance, all three are used in combination with each other, in another instance a loading dose approach and a dosing holiday approach are employed together and in a further preferred instance a dosing frequency and dosing holiday approach are employed together. Hence, in the instance of the loading dose and dosing holiday being combined it may be that after an initial batch of doses of the sclerostin antibody, including the high initial dose(s) and lower dose(s), the subject then has a dosing holiday period, where they are not given sclerostin antibodies. In the case where a dosing frequency and loading dose approach are employed together, it may be that the subject is given at least two doses of sclerostin antibody at the initial frequency, then given one or more subsequent doses of the sclerostin antibody at the reduced frequency and then given a dosing holiday, where at least one of the initial doses is a loading dose. The length of the dosing holiday may be, for instance, any of the lengths described herein and may be, for example, a period that is at least two, three, four, five, six, seven, eight, nine, or ten times the length of the interval between the doses in the reduced frequency period of dosing.

The basic concept of a dosing holiday is that after successive doses of sclerostin antibody, subjects begin to show a reduced response which is lower than the "naïve" response seen when the sclerostin antibody is administered for the first time to the subject. Allowing the subject a dosing holiday, when the antibody is not administered, means the response the subject will display to a dose of sclerostin antibody will return back towards the "naïve" response level. In a particularly preferred instance, a different bone treatment is administered during the dosing holiday and in particular an anti-resorptive.

Non-limiting examples of various embodiments provided by the invention are set out below.

The invention provides a method for treating a bone disorder associated with at least one of low bone formation, low bone mineral density, low bone mineral content, low bone mass, low bone quality and low bone strength in a mammalian subject, which method comprises:

(a) administering an initial loading dose or doses of sclerostin antibody to a subject in need of such treatment; and (b) administering a further dose or doses of sclerostin antibody to the subject in need of such treatment which are lower than the initial loading dose of (a).

The present invention also provides an sclerostin antibody for use in a method for treating a bone disorder associated with at least one of low bone formation, low bone mineral density, low bone mineral content, low bone mass, low bone quality and low bone strength in a mammalian subject, which method comprises:

(a) administering an initial loading dose or doses of sclerostin antibody to a subject in need of such treatment; and (b) administering a further dose or doses of sclerostin antibody to the subject in need of such treatment which are lower than the initial loading dose(s) of (a).

The invention further provides the use of an sclerostin antibody in the manufacture of a medicament for treating a bone disorder associated with at least one of low bone formation, low bone mineral density, low bone mineral content, low bone mass, low bone quality and low bone strength in a mammalian subject, where the medicament is to be administered in a method comprising:

(a) administering an initial loading dose or doses of sclerostin antibody to a subject in need of such treatment; and (b) administering a further dose or doses of sclerostin antibody to the subject in need of such treatment which are lower than the initial loading dose of (a).

The invention additionally provides a method for treating a bone disorder associated with at least one of low bone formation, low bone mineral density, low bone mineral content, low bone mass, low bone quality and low bone strength in a mammalian subject, which method comprises:

(a) administering at least two doses of sclerostin antibody to a subject in need of such treatment; and (b) administering a further dose or doses of sclerostin antibody to the subject in need of such treatment, where the further doses are administered at a lower frequency than the doses of (a).

The invention further provides an sclerostin antibody for use in a method for treating a bone disorder associated with at least one of low bone formation, low bone mineral density, low bone mineral content, low bone mass, low bone quality and low bone strength in a mammalian subject, which method comprises:

(a) administering at least two doses of sclerostin antibody to a subject in need of such treatment; and (b) administering a further dose or doses of sclerostin antibody to the subject in need of such treatment, where the further dose(s) are administered at a lower frequency than the doses of (a).

In addition, the invention further provides for use of an sclerostin antibody in the manufacture of a medicament for treating a bone disorder associated with at least one of low bone formation, low bone mineral density, low bone mineral content, low bone mass, low bone quality and low bone strength in a mammalian subject, where the medicament is to be administered in a method comprising:

(a) administering at least two doses of sclerostin antibody to a subject in need of such treatment; and (b) administering a further dose or doses of sclerostin antibody to the subject in need of such treatment, where the further doses are administered at a lower frequency than the doses of (a).

Figure 1:
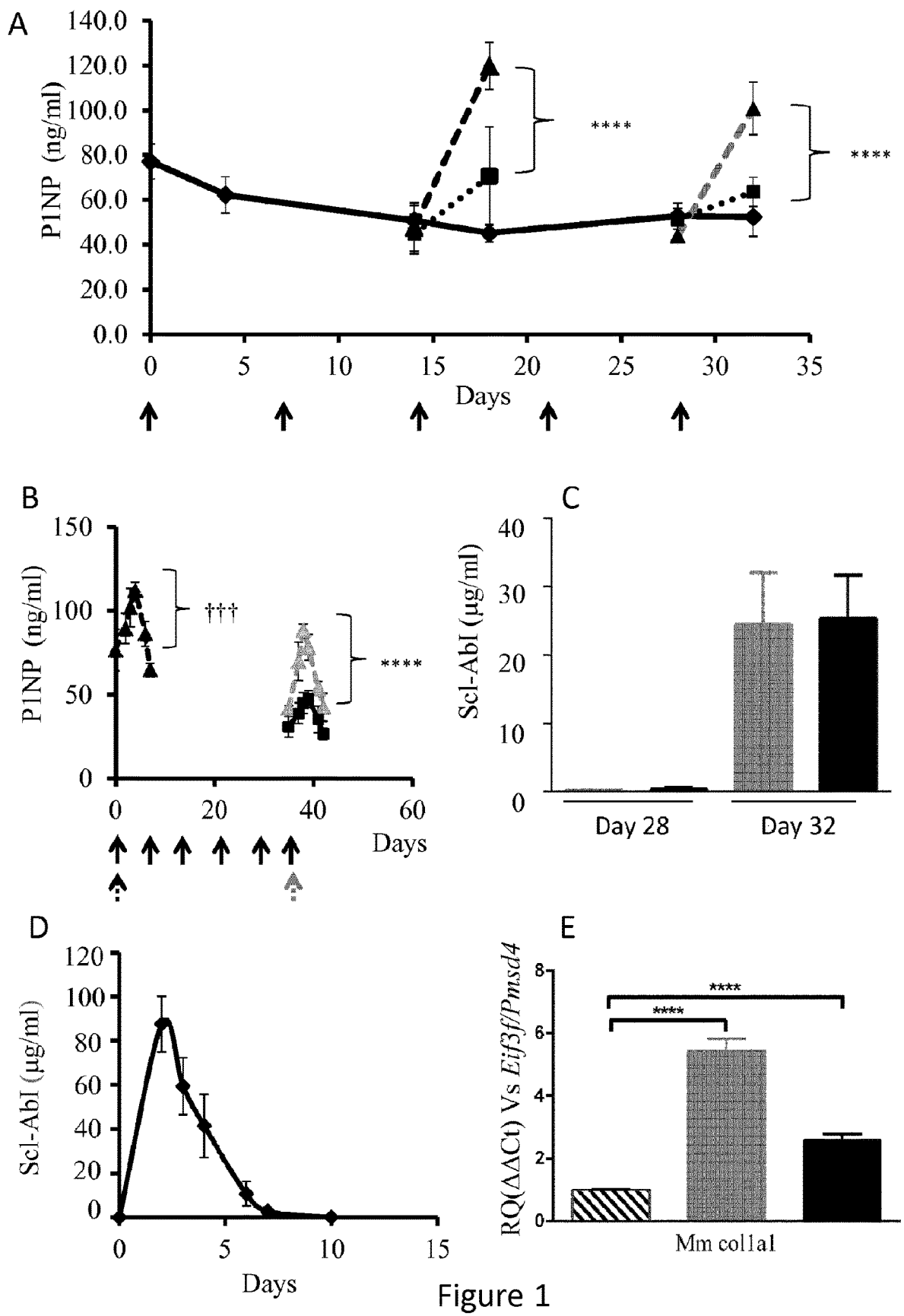
FIG. 1A shows circulating P1NP levels in control mice and mice treated with an sclerostin antibody (Scl-AbI). Control mice (black solid line) were dosed weekly with PBS and circulating P1NP monitored throughout the experiment. A second age-matched group of mice were dosed weekly with the sclerostin antibody and P1NP levels measured on days 14, 18, 28 and 32 (black dotted line). A third age matched group of mice were dosed with PBS on days 0 and 7 and then exposed to sclerostin antibody first on day 14 (black dashed line); their P1PN levels were measured on days 14 and 18. The final group of age-matched mice were dosed with PBS on days 0, 7, 14 and 21 (grey dashed line) and then exposed to sclerostin antibody for the first time on day 28 and their P1NP levels measured on days 28 and 32. Sclerostin antibody dosing was at 10 mg/kg s.c. in all cases.

The arrows indicate days on which mice were dosed as described. The data shows mean+/−SD. **** p<0.0001 (n=5-20).

FIG. 1B shows the kinetics of P1NP response after exposure to sclerostin antibody. The mean serum concentration of P1NP over a 7 day period is shown in a group of mice dosed for the first time with sclerostin antibody at day 0 (dashed black line). The serum concentrations of P1NP is also shown (between days 35 and 42) for groups of age-matched mice dosed for the first time on day 35 (dashed grey line) and mice dosed for the sixth time on day 35 (solid black line). The arrows mark the times at which sclerostin antibody was administered (10 mg/kg, s.c.). The data shows mean and SD. * shows comparison of mean peak P1NP levels in multiply-dosed group and previously antibody-naïve mice. **** p<0.0001 (n=4-5). †shows a comparison of mean P1NP levels on day 0 (pre-dose) and day 4 (†††p<0.001 (n=4-5).

FIG. 1C shows plasma levels of sclerostin antibody on day 28 (prior to dose) and day 32 in mice whose P1NP levels are shown in FIG. 1B. Grey bars show sclerostin antibody levels in mice exposed to sclerostin antibody for the first time on day 28 and the black bars show the levels in mice receiving the fifth dose of sclerostin antibody on day 28. Data shows mean+/−SD. (n=5-20).

FIG. 1D shows plasma levels of sclerostin antibody after dosing of 10 mg/kg s.c. on day 0. Data shows mean+/−SD. (n=5).

FIG. 1E shows Col1a1 mRNA levels in the femurs of mice with and without exposure to sclerostin antibody. Femurs were removed from mice given five doses (weekly) of PBS (striped bars), four doses of PBS (weekly) followed by a single dose of Scl-AbI (grey bar) or five doses (weekly) of sclerostin antibody (black bar) and the level of Col1a1 mRNA determined via TaqMan. Data shows mean+/−SD. **** p<0.0001 (n=6).

FIG. 2A shows an extension of FIG. 1 showing peak P1NP levels after sclerostin antibody following dose-free intervals. The P1NP levels in animals receiving multiple doses of sclerostin antibody are shown by the squares and the levels in animals receiving sclerostin antibody for the first time are shown by the triangles. P1NP levels in control animals dosed with PBS are shown by the diamonds (solid black line). The dosing regimen for mice receiving multiple doses of sclerostin antibody is shown by the arrows below the Figure. P1NP was measured four days after sclerostin antibody dosing. Data shows mean+/−SD. * shows comparison of P1NP levels four days after sclerostin antibody dosing in multiply-dosed animals and antibody-naïve mice. **** p<0.0001 (n=5-20).

FIG. 2B shows whole body BMD in mice dosed with PBS (black line) or 10 mg/kg s.c. sclerostin antibody (dotted line). The mice were dosed at the times indicated by arrows under the figure. Data shows mean+/−SD. ** p<0.0001, p<0.01 (n=5-10).

Figure 3:
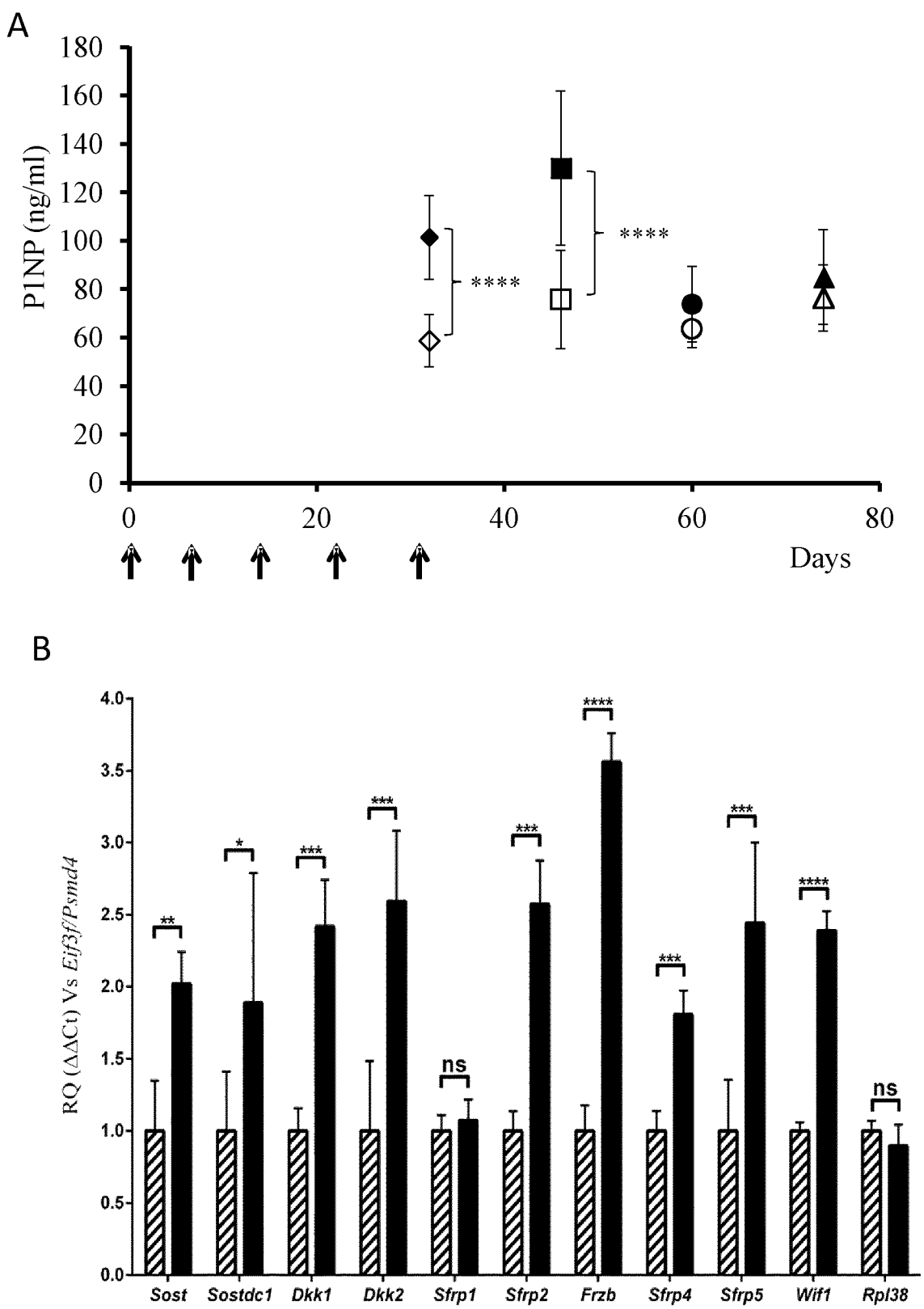

FIG. 3A shows the reversal of the attenuated P1NP response after a dose free interval. Mice were dosed weekly on five occasions with 10 mg/kg s.c. sclerostin antibody. After various dose-free intervals, the P1NP responses in subgroups of these mice were compared with the P1NP response in age-matched mice dosed with sclerostin antibody for the first time. Diamonds show comparison after no dose-free interval, squares after two weeks dose-free, circles after four weeks dose-free and triangles six weeks dose-free. Open symbols represent animals that have previously been exposed to sclerostin antibody and black symbols represent data from animal not previously exposed to antibody. Data shows mean+/−SD. ****=p<0.0001 (n=7/8).

FIG. 3B shows mRNA levels in the femurs of mice with and without exposure to Scl-AbI. Femurs were removed from mice given 5 weekly doses of PBS (striped bars) or 5 weekly doses of sclerostin antibody and the levels of mRNA measured for a range of soluble Wnt inhibitors. Data shows mean+/−SD * p<0.05,  p<0.01, * p<0.001, **** p<0.0001 (n=6).

Figure 4:
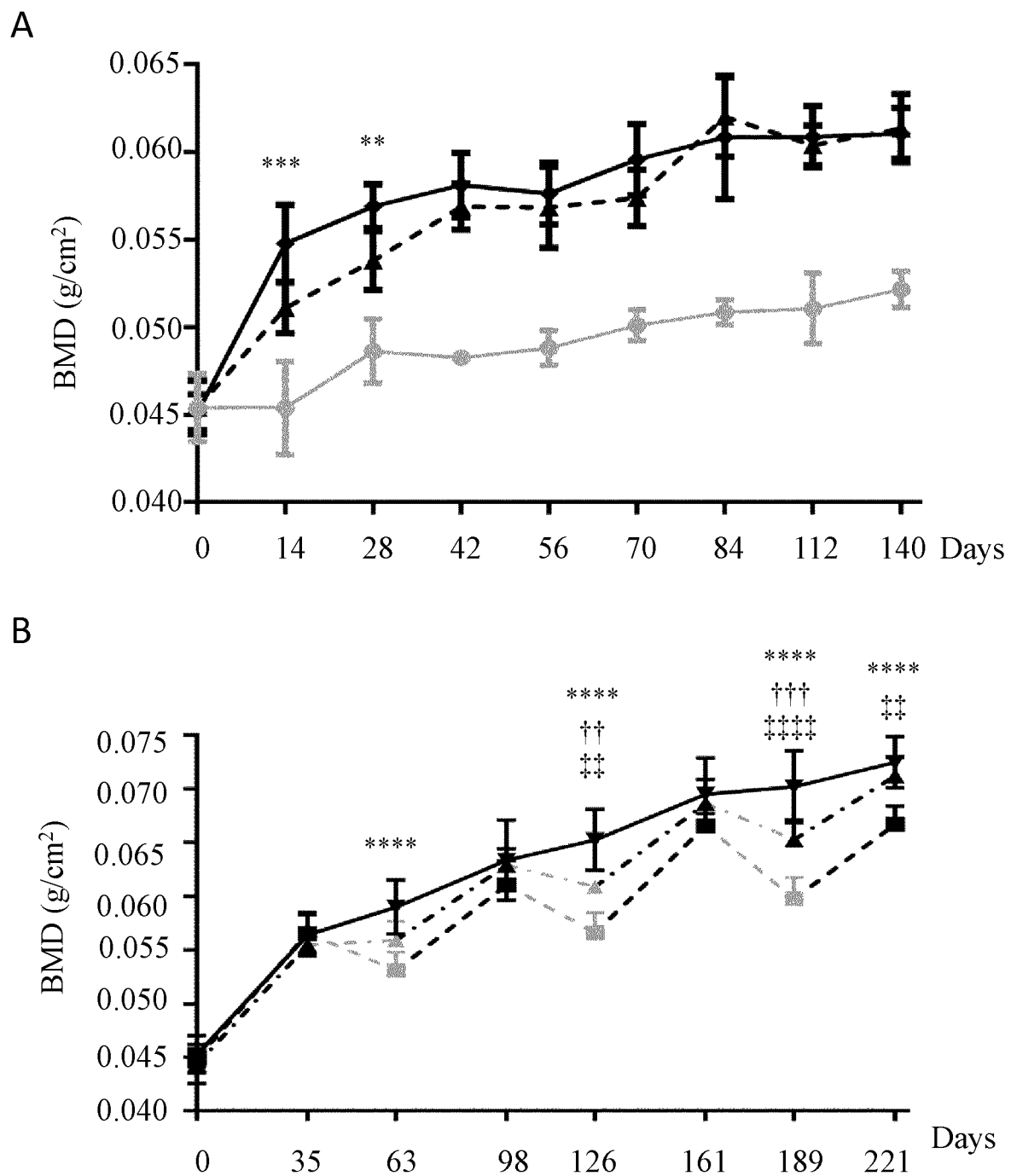

FIG. 4A shows whole body BMD in mice dosed with sclerostin antibody. Groups of mice were dosed weekly with PBS (grey line), 10 mg/kg s.c. of sclerostin antibody (dotted black line) or an initial loading dose of 50 mg/kg s.c. sclerostin antibody followed by weekly s.c. doses of 10 mg/kg (solid black line). The BMD in both the sclerostin antibody dosed groups was significantly different from the PBS group by day 14 until the end of the experiment. The stars indicate a significant difference between the two sclerostin antibody dosed groups at days 14 and 28.  p<0.01, * p<0.001 (n=8).

FIG. 4B shows whole body BMD in mice dosed with sclerostin antibody, alternating periods of sclerostin antibody and PBS or alternating periods of sclerostin antibody and alendronate. The black solid line shows the whole body BMD in mice dosed weekly with sclerostin antibody (10 mg/kg s.c.) throughout the experiment. The dashed line shows the BMD in mice dosed with alternating periods of sclerostin antibody (10 mg/kg s.c) and PBS. The dash/dotted line shows the BMD in mice dosed with alternating periods of sclerostin antibody (10 mg/kg s.c.) and alendronate (0.2 mg/kg s.c., weekly). In all cases antibody dosing was weekly. Periods of antibody dosing are shown in black and periods of dosing with PBS or alendronate are shown in grey. Data shows mean+/−SD. * shows comparison of BMD in sclerostin antibody group with BMD in sclerostin antibody/PBS **** p<0.0001, †shows comparison of sclerostin antibody group with Scl-AbI/alendronate group †† p<0.01, ††† p<0.001 shows comparison of sclerostin antibody/PBS group with sclerostin antibody/alendronate group ‡‡ p<0.01, ‡‡‡‡ p<0.0001 (n=8).

Figure 5:
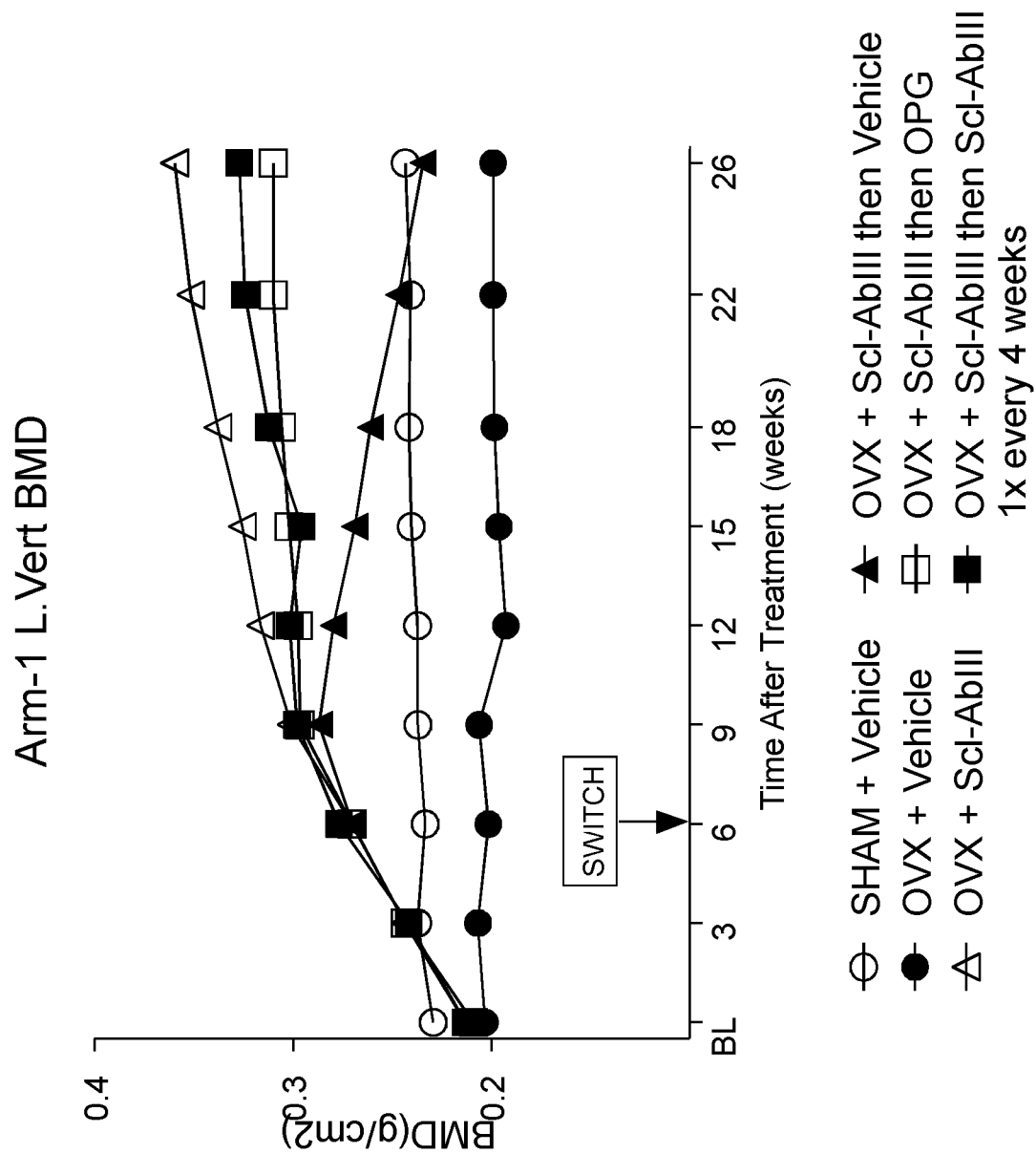

FIG. 5 shows vertebral bone mineral density (BMD) in g/cm$^2$ in SD rats that have been: sham ovariectomised and given vehicle alone at the dosing points (open circles); ovariectomised then given vehicle alone (filled circles); ovariectomised then given sclerostin antibody once a week both before and after the switchover point at six weeks (open triangles); ovariectomised then given sclerostin antibody once a week before the switch and then vehicle alone after it (filled triangles); ovariectomised, then given sclerostin antibody once a week until the switch and then osteoprotegerin (OPG) once a week (open squares); ovariectomised then given sclerostin antibody once a week before the switch and then sclerostin antibody once every four weeks after the switchover (filled squares).

Figure 6:
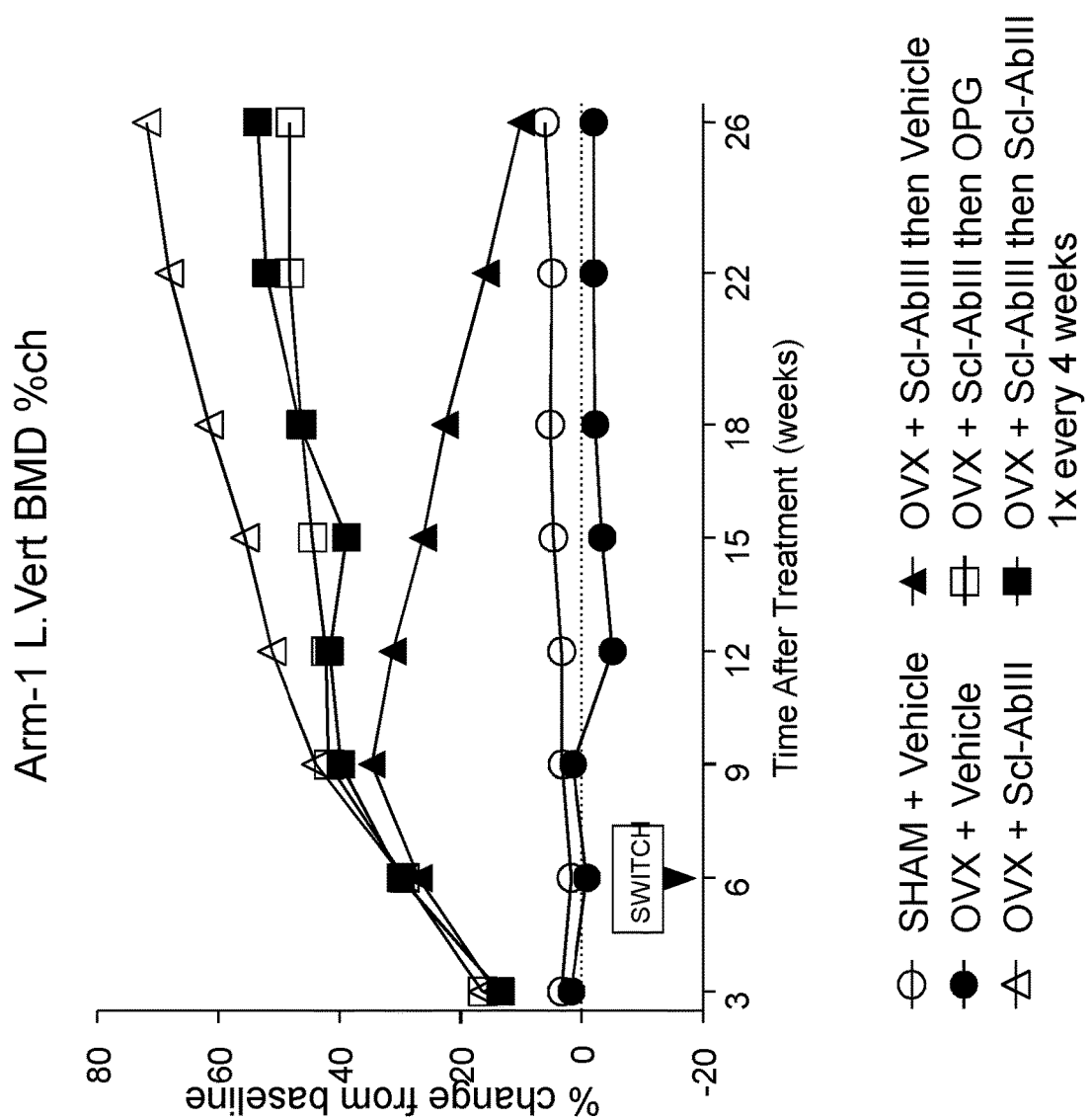

FIG. 6 shows percentage change from baseline in vertebral bone mineral density (BMD) in the same groups of rats as FIG. 5.

Figure 7:
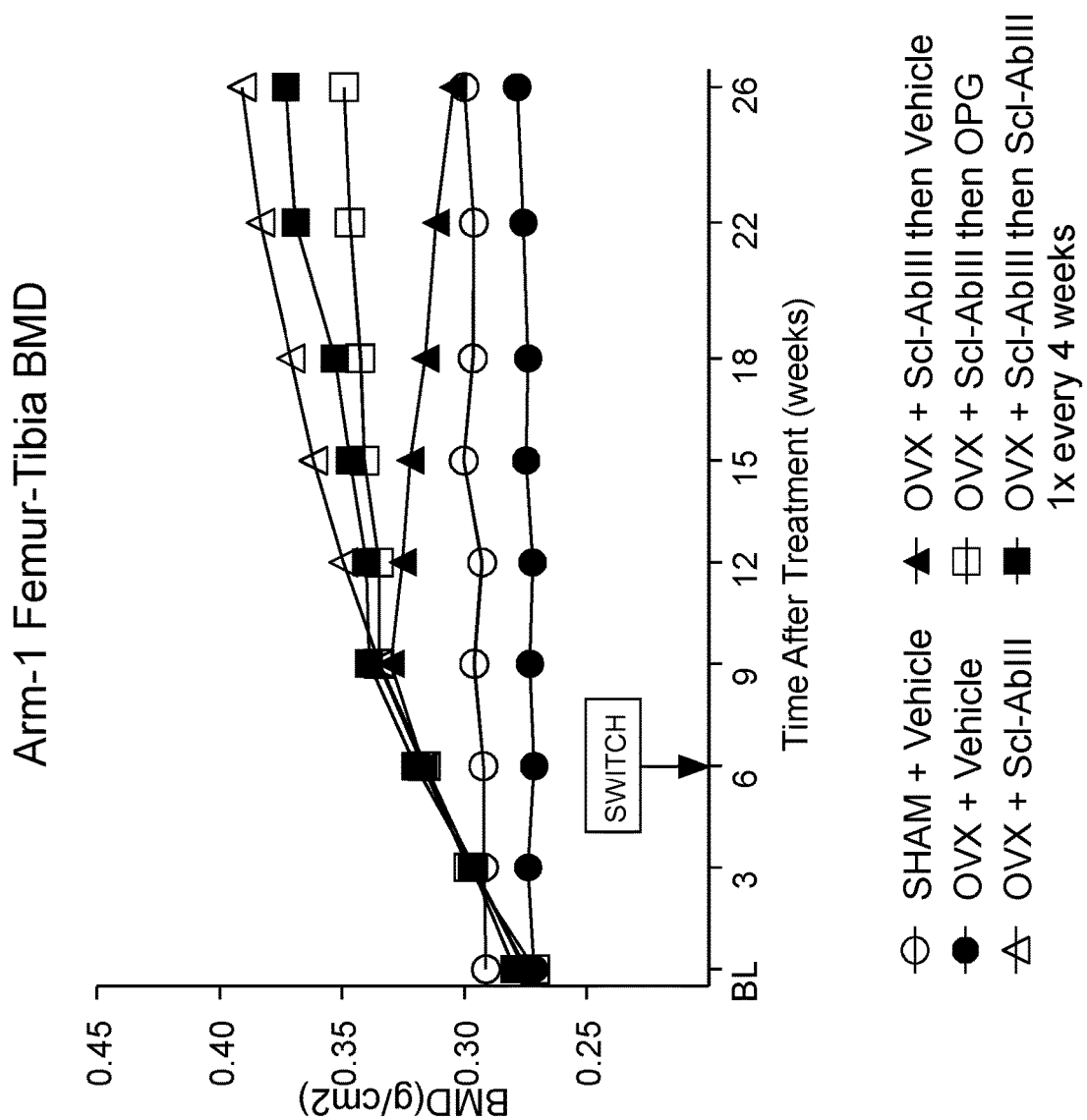

FIG. 7 shows Femur-Tibia bone mineral density (BMD) in g/cm$^2$ for the same group of rats as FIG. 5.

Figure 8:
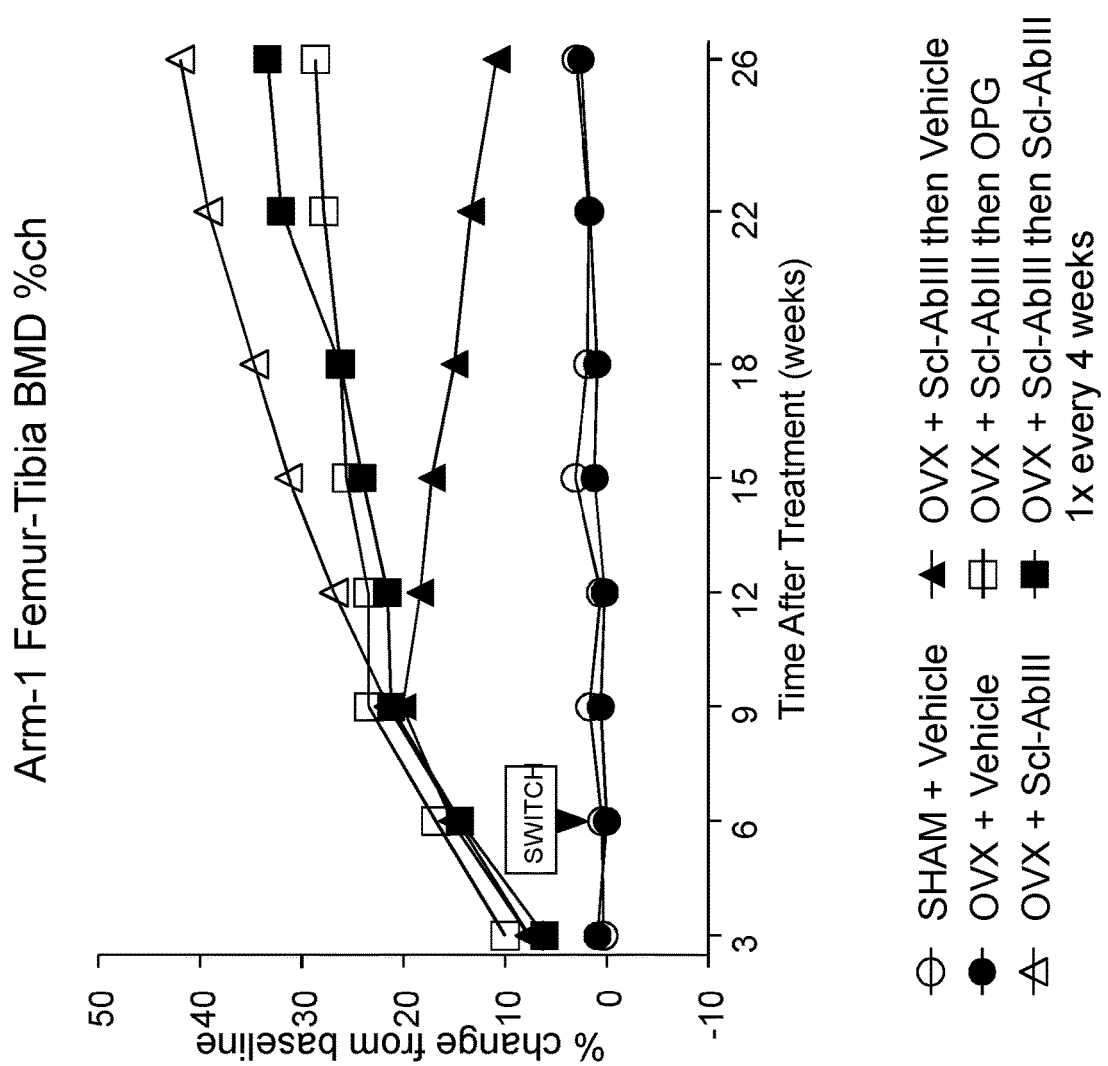

FIG. 8 shows percentage change from baseline in Femur-Tibia (BMD) in the same group of rats as FIG. 7.

Figure 9:
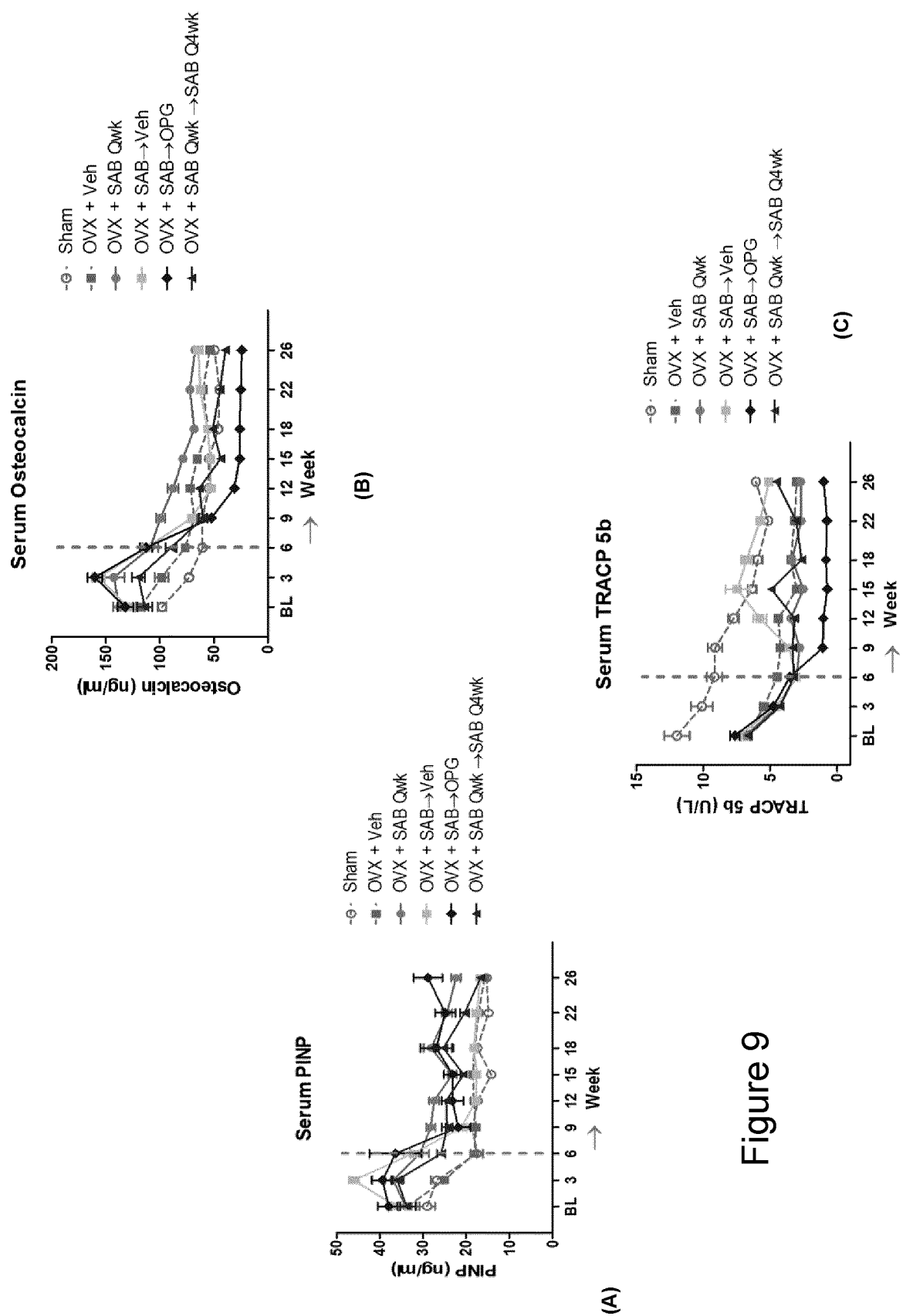

FIG. 9 shows measurement of three separate serum biomarkers in the same groups of rats, the markers being serum PINP (panel (A) in the Figure), serum osteocalcin (panel (B) in the Figure) and Tracp 5b (panel (C) in the Figure. The groups of rats shown are, going from top to bottom in the key to each panel: sham ovariectomised rats ("sham"—open circle, broken line); ovariectomised rats given vehicle for both the first and second period a ("OVX+Veh"—dark grey squares, broken line); ovariectomised rats given sclerostin antibody once a week for both the first and second periods ("OVX+SAB Qwk—dark grey circles with unbroken line); ovariectomised rats given sclerostin antibody once a week for the first period and then vehicle in the second time periods ("OVX+SAB→Veh—light grey squares, unbroken line); ovariectomised rats given sclerostin antibody once a week for the first period and then osteoprotegerin in the second period ("OVX+SAB→OPG—black diamonds, unbroken line); ovariectomised rats given sclerostin antibody once a week for the first period and then in the second period sclerostin antibody once every four weeks in the second period ("OVX+SAB→Qwk—dark grey triangles, unbroken line).

FIG. 10 is a chart listing amino acid sequences and sequence identifiers for amino acid sequences of various sclerostin antibodies described herein. The sequence identifiers refer to amino acid sequences provided in the Sequence Listing submitted herewith. The amino acid sequences also are set forth in U.S. Patent Publication No. 20070110747, hereby incorporated by reference.

DETAILED DESCRIPTION OF THE INVENTION

Loading Doses

In the loading approach provided, an initial high dose or doses of a sclerostin antibody is given as a loading dose or doses. The subject is subsequently administered a dose or doses which are lower than the initial loading dose(s). The loading dose(s) are therefore higher than the subsequent doses. For instance, in some cases, a loading dose may be about two, three, four, five, six, seven, eight, nine or ten times the dose of one of the subsequent lower doses, or may be at least such values or a range comprising any pair of those values as endpoints. In some instances, the loading dose(s) may be about two to twelve, three to ten, or four to eight times one of the subsequent lower doses or may be in a range comprising any combination of those endpoints. In some instances, the loading dose(s) may be each between about 250 mg to 3000 mg, for example from about 300 mg to 2500 mg, preferably from about 500 mg to 2000 mg, or in a range comprising any combination of those endpoints. In some instances, the initial dose or doses may be each about 3 to 50 mg/kg, for instance from about 7 to 50 mg/kg, in some cases from 10 to 40 mg/kg, for example from 20 to 30 mg/kg, or in a range having any combination of those endpoints. It may be that a loading dose is about 4, 5, 7, 10, 15, 20, 25, 30, 35 or 40 mg/kg or in a range comprising any combination of those values as endpoints. In some instances, the loading dose(s) of sclerostin antibody may be from 300 mg to 900 mg, for instance from 400 mg to 800 mg, such as from 400 mg to 600 mg. In other instances, the loading dose of sclerostin antibody may be from 450 mg to 550 mg and in some cases may be about 500 mg. In some instances, the loading dose of sclerostin antibody may be about 400 mg, 425 mg, 450 mg, 475 mg, 500 mg, 525 mg, 550 mg, or 600 mg, or may be in a range with any of two of those values as endpoints. Other examples of possible loading doses include about 250 mg, 275 mg, 300 mg, 325 mg, 350 mg, 375 mg, or 400 mg or the loading dose being in a range comprising two of those values as endpoints.

In some cases, more than one loading dose of sclerostin antibody may be administered, for instance one, two, three, four, or five loading doses may be given, for instance with any of the intervals discussed herein for doses. In some embodiments, from one to five, one to four, one to three or two to four loading doses of sclerostin antibody may be given. In an especially preferred instance, a single loading dose of sclerostin antibody is given and then the lower doses administered. Hence, in any of the embodiments discussed herein, it may be that a single loading dose of sclerostin antibody is administered unless otherwise stated. In some instances, the subject may be administered a batch of doses of sclerostin antibody which comprise the loading dose(s) and the subsequent lower dose(s).

In any of the embodiments discussed herein, it may be therefore that the subject is only ever given loading dose(s) of sclerostin antibody at the start of their treatment with sclerostin antibodies, particularly where the subject is one that needs an initial rapid increase in bone formation. In other instances, it may be that the subject has already been given sclerostin antibody, but has been identified as being in need of a rapid increase in bone, so the loading dose approach is applied. In one instance, the approach provided may comprise assessing the subject to determine if the loading approach should be applied and then administering a batch of doses comprising a loading dose or dose(s) and the lower dose or doses. In one preferred instance, the subject is given an initial batch of doses comprising a loading dose(s) of sclerostin antibody and is then monitored, with a further batch of dose(s) comprising a loading dose or doses being administered if the subject would again benefit from the more rapid boost to bone formation brought about by administering loading dose(s) sclerostin antibody.

In the approach provided, after the loading dose(s) sclerostin antibody are administered, at least one lower dose of sclerostin antibody is administered. The lower dose may be, for instance, referred to as a maintenance dose. In some instances, at least about two, three, four, five, six, seven, eight, nine, ten, eleven, twelve, thirteen, fourteen or more subsequent lower doses of sclerostin antibody are administered to the subject after the loading dose(s). In one instance, the lower doses are given for up to about 6 months, up to about eight months, up to about ten months, up to about 12 months, or up to 18 months. In some cases, the subject may be administered two, three, four, or five times as many lower dose(s) as loading dose(s). In one particularly preferred instance, the subject is administered a single loading dose and then from one to ten lower doses, preferably from two to seven lower doses, more preferably from three to six lower doses and even more preferably five lower doses of sclerostin antibody. The lower doses may be any suitable amount, but by definition are smaller than the loading dose sclerostin antibody. Examples of suitable lower doses are given below. In some instances, after the loading dose(s) sclerostin antibody have been administered, the subject is indefinitely given further doses of sclerostin antibody to help treat their condition, optionally interspersed with a dosing holiday or holidays as discussed elsewhere herein.

In some cases, the subject may be administered a batch of doses sclerostin antibody, for instance, a batch of doses may comprise the loading dose(s) and then the lower doses. In any of the references herein to a batch of doses comprising a loading dose or doses, the loading dose(s) are typically the first doses given in the batch. Hence, a batch may, for instance, comprise the number of loading dose(s) and lower doses as specified anywhere herein and in a preferred instance the end of a batch may define the start of a dosing holiday. In one preferred instance, the subject is given a plurality of batches of doses sclerostin antibody with a dosing holiday between batches, with only the first batch of doses comprising a loading dose. In other instances, the approach provided may comprise administering a batch of doses comprising loading dose(s) when the subject is identified as being in need of a loading dose sclerostin antibody to give a marked increase in bone formation.

In some cases, a batch of doses of sclerostin antibody may comprise the loading dose(s) and lower dose(s) with the end of the batch of doses being defined by the start of a dosing holiday, as discussed below. In some cases, a batch of doses may comprise the loading dose(s) and one or more lower dose(s) with overall the batch comprising a set number of doses. In instances entailing a dosing frequency approach, it may be that a batch of doses comprises either the overall number of doses given or the number of doses given before a dosing holiday is administered. In some cases a batch of dose(s) may comprise from 4 to 25 doses of sclerostin antibody, for example from 4 to 20 doses of sclerostin antibody, such as from 5 to 15 dose(s), in some instances from 5 to 12 doses of sclerostin antibody, or in other cases a range with any of the values referred to above as endpoints. In other cases, a batch of doses may comprise about 5, 6, 7, 8, 9, 10, 11, 12, 13, 14, or 15 dose(s) or a range with any combination of those values as endpoints.

The amount of sclerostin antibody administered as an individual lower dose to the subject, after a loading dose or doses may, for instance, comprise at least about 70 mg of the sclerostin antibody. For example, in various aspects, the amount of sclerostin antibody administered is at least about 120 mg (e.g., 180 mg) or at least about 140 mg, e.g., at least about 210 mg sclerostin antibody. The amount of sclerostin antibody administered as a lower dose may be, for instance, no more than about 300 mg sclerostin antibody (e.g., 270 mg), no more than about 210 mg of sclerostin antibody, no more than about 140 mg sclerostin antibody, or no more than about 120 mg sclerostin antibody (e.g., about 120 mg of antibody). The lower dose may be, for instance, about 80, 70, 60, 50 or 40 mg. In one instance, the loading dose(s) and lower dose(s) may have any combination of the values specified herein for the loading dose and lower dose, so long as the lower dose is a smaller amount than that administered as the higher dose.

In some instances, the subject is administered a lower dose of sclerostin antibody in an amount of about 70 mg to about 350 mg, such as about 70 mg to about 280 mg, or about 120 mg to about 350 mg, or about 140 mg to about 350 mg, or about 210 mg to about 350 mg, or about 280 mg to about 350 mg. Optionally, a single lower dose of sclerostin antibody comprises about 70 mg to about 210 mg of sclerostin antibody, such as about 70 mg to about 120 mg (e.g., about 70 mg) sclerostin antibody, or about 70 mg to about 140 mg of sclerostin antibody, or about 120 mg to about 210 mg sclerostin antibody, or about 120 mg to about 140 mg of sclerostin antibody. Optionally, a single lower dose of sclerostin antibody comprises about 140 mg to about 210 mg (e.g., about 140 mg or about 210 mg) of sclerostin antibody.

In some preferred instances, the lower dose of sclerostin antibody administered may be about 40 mg, 50 mg, 60 mg, 70 mg, 80 mg, 90 mg, 100 mg, 110 mg, 120 mg, 130 mg, 140 mg or 150 mg or be in a range with any two of those values as endpoints. In one instance, such dose(s) are used in combination with loading dose(s) of sclerostin antibody from 300 mg to 900 mg, for instance from 400 mg to 800 mg, such as from 400 mg to 600 mg. In other instances, the loading dose of sclerostin antibody used with those lower doses may be from 450 mg to 550 mg and in some cases may be about 500 mg. In some instances, the loading dose of sclerostin antibody used with the lower doses of sclerostin antibody may be about 400 mg, 425 mg, 450 mg, 475 mg, 500 mg, 525 mg, 550 mg, or 600 mg sclerostin antibody, or may be in a range with any of two of those values as endpoints. Other examples of possible loading doses used in combination with the above mentioned lower doses include about 250 mg, 275 mg, 300 mg, 325, 350 mg, 375 mg, or 400 mg or the loading dose being in a range comprising any of those two values as endpoints.

In some instances, the dose administered as a lower dose sclerostin antibody is between about 0.1 to about 20 mg/kg, or about 0.1 to about 12 mg/kg, or about 0.5 to about 12 mg/kg, or about 1 to about 10 mg/kg, or about 1 to about 8 mg/kg, or about 2 to about 8 mg/kg, or about 3 to about 8 mg/kg. In some instances, a dose is about 1 mg/kg to about 10 mg/kg (e.g., about 2 mg/kg or about 9 mg/kg), about 1 mg/kg to about 3 mg/kg, or about 3 mg/kg to about 8 mg/kg (e.g., about 4 mg/kg, 5 mg/kg, 6 mg/kg, or 7 mg/kg). In the case of individuals with significantly lower or higher weight than average, it may some times be that the dose is calculated based on a per weight basis specifically for that subject.

Any of the lower doses of sclerostin antibody mentioned herein may be used in combination with any of the loading dose(s) of sclerostin antibody disclosed herein, so long as the loading dose(s) employed are greater than the lower dose(s) used.

In a further instance, a loading dose or dose(s) are given and then a stepped reduction is made for each of the subsequent doses. For instance, a loading dose may be administered, then each subsequent dose is reduced progressively until one of the levels specified herein for a particular lower dosage is reached. In a preferred embodiment though, a single loading dose is given and then the subsequent lower doses are all the same, or approximately the same. In other embodiments, the subject matter is administered loading dose(s) and then the lower dose(s) without any stepwise reductions, just a switch from the amount given for loading dose(s) to that given for the lower dose(s).

In one instance, in any of the approaches described herein, the subject may, for instance, have a body weight of from about 35 kg to 80 kg, in particular from about 40 kg to 70 kg, in some cases from 45 kg to 60 kg or a range with any combination of those endpoints. The subject may be male or female, in one preferred instance the subject is female, in a further preferred instance the subject is female and has one of the above specified weight ranges. In any of the approaches discussed herein it may be that a fixed regimen is designed for the subject with reference to age, gender, weight, the nature of the disorder, the severity of the disorder and so on.

Reference herein to a single dose may include multiple contemporaneous injections be administered to achieve delivery of the dose. For instance, several injections within the space of an hour, day or week. In a preferred instance though a dose is given as a single injection or infusion. In one instance, any of the doses referred to herein may be administered intravenously, for instance by intravenous injection or via an intravenous infusion. In a preferred instance, the loading dose sclerostin antibody is given by intravenous infusion.

The loading dose approach may be employed in combination with the dosing frequency and/or dosing holiday approaches discussed below. Any of the specific dosages and other parameters discussed above in relation to the loading dose approach may also be employed when the loading dose approach is used in combination with the other approaches or indeed in the other approaches when employed on their own without the loading dose approach.

Dosing Frequency

In one instance, dosing frequency may be altered as a way to alter the rate of bone formation. For instance, by altering dosing frequency an initial faster rate of bone formation may be replaced by a slower rate of formation, so an initial higher frequency of doses sclerostin antibody may be replaced by lower frequency dosing sclerostin antibody. Such alteration of doing frequency may be used as a way to control bone formation and also as a way of having to use less antibody once the subject has had the initial faster rate of bone formation. The approach may be adopted, for instance, as a way to maintain or slowly add to the initial burst of bone formation. The dosing frequency approach may be used as an alternative to the loading dose approach or in addition to it. It may also be used in combination with the dosing holiday approach and in one instance the loading dose, dosing frequency and dosing holiday approaches are employed in combination together.

In one instance, the invention therefore provides an sclerostin antibody for use in a method for treating a bone disorder associated with at least one of low bone formation, low bone mineral density, low bone mineral content, low bone mass, low bone quality and low bone strength in a mammalian subject, which method comprises:

(a) administering at least two doses of sclerostin antibody to a subject in need of such treatment; and (b) administering a further dose or doses of sclerostin antibody to the subject in need of such treatment, where the further dose(s) are administered at a lower frequency than the doses of (a).

In the instance where the dosing frequency approach is being used without the loading dose approach, the doses of (a) and (b) may be equal or approximately equal. For instance, the amounts of the later doses may be, for example, within about 50%, 40%, 30%, 20%, 10%, or 5% of the amount of the initial higher frequency doses. The amounts of the later doses of (b) may be within, in some cases, about 25%, 20%, 15%, 10% or 5% of the initial doses. In some cases, the amount of the doses of (b) may be within a range with any of the above values as endpoints. Such percentage differences may, in some cases, be in terms of mg/kg sclerostin antibody administered to the subject or in terms of the total dose administered per dose.

The amount of sclerostin antibody administered as a dose to the subject, may, for instance, comprise at least about 70 mg of the sclerostin antibody. For example, in various aspects, the amount of sclerostin antibody administered is at least about 120 mg (e.g., 180 mg) or at least about 140 mg, e.g., at least about 210 mg sclerostin antibody. The amount of sclerostin antibody administered as a dose may be, for instance, no more than about 300 mg sclerostin antibody (e.g., 270 mg), no more than about 210 mg of sclerostin antibody, no more than about 140 mg sclerostin antibody, or no more than about 120 mg sclerostin antibody (e.g., about 120 mg of antibody). A dose given in the dosing frequency approach may be, for instance, about 80, 70, 60, 50 or 40 mg. In one instance, the doses of (a) and/or (b) may have any combination of the values specified herein for doses.

In some instances, the subject is administered a dose of sclerostin antibody in an amount of about 70 mg to about 350 mg, such as about 70 mg to about 280 mg, or about 120 mg to about 350 mg, or about 140 mg to about 350 mg, or about 210 mg to about 350 mg, or about 280 mg to about 350 mg. Optionally, a dose of sclerostin antibody comprises about 70 mg to about 210 mg of sclerostin antibody, such as about 70 mg to about 120 mg (e.g., about 70 mg) sclerostin antibody, or about 70 mg to about 140 mg of sclerostin antibody, or about 120 mg to about 210 mg sclerostin antibody, or about 120 mg to about 140 mg of sclerostin antibody. Optionally, a single lower dose of sclerostin antibody comprises about 140 mg to about 210 mg (e.g., about 140 mg or about 210 mg) of sclerostin antibody.

In other instances, dose(s) of sclerostin antibody administered may be from 300 mg to 900 mg, for instance from 400 mg to 800 mg, such as from 400 mg to 600 mg. In other instances, the dose of sclerostin antibody may be from 450 mg to 550 mg and in some cases may be about 500 mg. In some instances, the dose of sclerostin antibody may be about 400 mg, 425 mg, 450 mg, 475 mg, 500 mg, 525 mg, 550 mg, or 600 mg, or may be in a range with any two of those values as endpoints. Other examples of possible doses include about 250 mg, 275 mg, 300 mg, 325, 350 mg, 375 mg, or 400 mg or the dose being in a range comprising any of those two values as endpoints. In some instances, the dose of sclerostin antibody administered may be about 40 mg, 50 mg, 60 mg, 70 mg, 80 mg, 90 mg, 100 mg, 110 mg, 120 mg, 130 mg, 140 mg or 150 mg or be in a range with any two of those values as endpoints. In other instances, the dose of sclerostin antibody may be about 50 mg, 100 mg, 150 mg, 200 mg, 250 mg, 300 mg, or 350 mg or in a range with any two of those values as endpoints.

In some instances, the dose sclerostin antibody administered is between about 0.1 to about 20 mg/kg, or about 0.1 to about 12 mg/kg, or about 0.5 to about 12 mg/kg, or about 1 to about 10 mg/kg, or about 1 to about 8 mg/kg, or about 2 to about 8 mg/kg, or about 3 to about 8 mg/kg. In some instances, a dose is about 1 mg/kg to about 10 mg/kg (e.g., about 2 mg/kg or about 9 mg/kg), about 1 mg/kg to about 3 mg/kg, or about 3 mg/kg to about 8 mg/kg (e.g., about 4 mg/kg, 5 mg/kg, 6 mg/kg, or 7 mg/kg). In the case of individuals with significantly lower or higher weight than average, it may sometimes be that the dose is calculated based on a per weight basis specifically for that subject.

In cases where the loading dose and dosing frequency are used in combination, the doses for each may be any of those specified herein, with the doses for the loading doses being any of those described herein for the loading dose aspect. In some instances, where the two approaches are used in combination, it may be that all of the doses of (a) of the dosing frequency approach are loading doses sclerostin antibody. In other instances, it may be that the number of loading doses administered in (a) is any of the number of loading doses specified herein, but the doses of (a) also comprise lower doses administered at the high frequency before the switch to low frequency dosing. In one preferred instance, it may be that only the first dose is a loading dose, but that the further doses of (a) before the switchover to the lower dosing frequency are lower doses, such as those discussed as the lower doses for the loading dose approach. Hence, in one embodiment a loading dose is administered, then one or more lower doses, then the switchover to lower dosing frequency may be made.

In any of the embodiments where a dosing frequency approach is employed, either with, or without, a loading dose approach, the change in interval between doses sclerostin antibody may be any appropriate change, for instance, to bring about the desired change in rate of bone density. It may be, for example, that the interval between doses is at least 50%, 100%, 150%, 200%, 250%, 300%, 350%, 400% or more than the interval between at least two of the doses of (a). In some cases the interval between the low frequency doses may be two, three, four, five, six, seven, eight, nine or ten times that between the higher frequency doses or about such amounts. In a preferred instance, it may be that the lower frequency doses are administered at an interval which is about two to seven times greater, preferably from three to six times, more preferably from three to five times and even more preferably four times the duration of the interval between doses in the initial higher frequency dosing.

The interval between two doses of sclerostin antibody may be, for instance, any of the values specified herein. It may be that, for instance, the initial doses of (a) are given every week, every two weeks, every three weeks, every four weeks, every five weeks, every six weeks or more. In another instance it may be that the interval of the doses of (b) is every two weeks, every three weeks, every four weeks, every five weeks, every six weeks, every eight weeks, every three months or more, so long as they are given less frequently than the doses of (a). In some cases, it may be that the initial doses of sclerostin antibody are given about every three to six weeks and the subsequent doses of (b) are given every four weeks to four months, so long as the doses of (b) are given less frequently. In one preferred instance, the initial doses of (a) are given about once every four weeks and the doses of (b) are given once every two to six months, preferably once very two to five months, and in some instances about every three to four months, in particular every four months.

It may be that the average duration of the intervals between doses for the doses of (a) and (b) have any of the above specified value, it may be that all of the intervals are around such duration.

In some cases the switch from the high rate of dosing to the lower frequency of dosing made be done progressively, so after the initial at least two doses of sclerostin antibody given at the higher frequency, the interval between doses is progressively increased, for instance, the increase may be by about a week, two weeks, three weeks or four weeks per dosing interval, it may be that the stepwise decrease in frequency is, for instance, done over two, three, four or five doses. In one instance, where such a stepwise decrease is employed, it may be that after the progressive decrease, the method then switches to a regular rate of dosing, but that regular rate of dosing is the lower level of dosing. In one instance, any of the combinations of higher and lower frequency doses discussed herein may involved such a stepped decrease, in other instances they may not.

Dosing Holidays

In some instances, the loading dose and/or dosing frequency approaches provided may be combined with, or comprise, a dosing holiday. Typically a dosing holiday is a time period where no sclerostin antibody is administered to a subject. Such a dosing holiday may help reduce, reverse or prevent the reduced response to a sclerostin antibody seen in subjects given a plurality of doses of the antibody and hence help improve the efficiency of treatment of bone disorders with sclerostin antibodies. In a particularly preferred instance, the subject is given an alternative treatment for the bone disorder during the dosing holiday.

Typically, the dosing holiday will result in reversal or reduction of a reduced response displayed by the subject to the sclerostin antibody. Hence, the subject may display a higher response to the antibody than prior to the dosing holiday. The subject may, for instance, display a response to the sclerostin antibody which is closer to the "naïve" response to the antibody when the subject was first administered the sclerostin antibody. For at least about 50%, 60%, 70%, 80%, 90%, 95%, or 99% of the naïve response or even about 100% of the naïve response. In a preferred instance, the dosing holiday will result in a higher response to the sclerostin antibody as measured by a bone marker, such as a marker of bone resorption and/or formation, including any of those mentioned herein, particularly P1NP. Any of the markers discussed herein may be employed to determine when to administer a loading dose or doses, but also to determine when to give a dosing holiday. They may also be used, in some cases, to determine when to switch to a lower rate of dosing in the dosing frequency approach or to determine whether the dosing frequency approach is applicable to a subject.

Typically, where a dosing holiday is employed, the administration of a batch of doses, followed by a dosing holiday and then administration of at least one dose of sclerostin antibody, means that the dosing regimen followed is one of irregular dosing. The dosing holiday may be viewed as a period of cessation of administration of sclerostin antibody which typically results in a subsequent increased response to the antibody. The length of a dosing holiday may vary. A dosing holiday will be typically longer in length than the interval between individual doses in a batch, for instance the interval between doses in a batch of doses known to have been administered to the subject or administered to the subject as part of the invention. In some instances, the dosing holiday may be any of the above specified lengths as long as the interval between doses in the preceding batch is shorter. In some instances, the dosing holiday may be any of at least 4, 5, 6, 7, 8, 19, 10, 11 or 12 weeks or about such duration. It may be the dosing holiday is at least 14, 16, 18, 20, 22, 24, 26, 28, 30, 35, 40, 45 or 50 weeks in length or may be of about such duration. In some instances, the dosing holiday may be from about four weeks to 52 weeks, for example from six weeks to 24 weeks, in some cases from eight weeks to 12 weeks.

In some instances of the invention, the dosing holiday may be about two months, three months, four months, five months, six months, seven months, eight months, nine months, ten months, eleven months or twelve months or at least those time periods. In some cases the dosing holiday may be about, or at least, eighteen months in length. For instance, the dosing holiday may be about four weeks, six weeks, eight weeks, ten weeks, or twelve weeks longer than the interval between doses in a batch of doses. In some instances, the dosing holiday may be equivalent to the total duration of a batch of doses given comprising the loading dose(s) and lower dose(s), such as any of those specified herein, or in other instances it may be equivalent to the overall duration of a batch of doses, plus an additional two, four, six, eight, twelve or more weeks in length.

In cases where the loading dose and dosing frequency approaches are used in combination, in one instance it may be that the dosing holiday is longer than the duration of the first batch of doses comprising the loading doses and the lower frequency doses. In one instance where the approaches are used in combination, it may be that only the first batch of doses uses the loading dose and/or dosing frequency approach. In some cases, it may be that only the first batch of doses of sclerostin antibody uses the loading dose approach, but at least one, or in some cases all, of the subsequent batches of doses of sclerostin antibody between dosing holidays adopt the dosing frequency approach.

It may be that the dosing holiday is at least two, three, four, five, six, seven, eight, nine or ten weeks longer than the interval between two doses in the preceding batch, or the dosing interval may be of such length. In some cases the dosing holiday may be such a length longer than the average interval for three, four, five, six, seven or more doses in a batch or, for example, than the average interval between all of the doses in a batch. The total length of the dosing holiday may be, for example, four, five, six, seven, eight, nine, ten or more weeks. For instance, the dosing holiday may be one, two, three, four, five or six months in length and in some cases may be at least a year, or eighteen months in length. In some cases, the dosing holiday may be from a month to a year, such as from two to six months in length. In some cases, the dosing holiday may be from four to sixteen weeks, for instance, from six to twelve weeks, for example from eight to ten weeks in length. In other instances, the dosing holiday may be about from six to eighteen months, for instance about a year. In some cases the dosing holiday may be about twice, three times, four times, five times, six times, seven times, eight times, nine times or more in duration than the interval between doses in a batch administered to the subject. In some instances, where a different treatment is administered during the dosing holiday, the duration of the dosing holiday may be the normal duration for a course of a different treatment for the disorder to be administered in the dosing holiday.

In any of the instances where the dosing frequency approach is employed, involving a switch to a lower dosing rate, a dosing holiday may be administered after the doses of (b). It may be that the dosing holiday is, for instance, two, three, four, five, six, seven, eight, nine or ten times in duration the interval between the lower frequency doses of (b). In some cases, the dosing holiday may be at least the duration of the time taken to administer the doses of (a) and (b) in the dosing frequency approach or indeed the doses of (a) and (b) in the loading dose approach. Where the subject is administered a batch of doses for the loading dose approach, or dosing frequency approach, or for the two in combination, in one instance, the dosing holiday is at least the duration of the batch of doses for the loading dose, dosing frequency or combined loading dose and dosing frequency approach.

In some cases, the subject is given more than one dosing holiday. In particular, after the first dosing holiday, the subject is given at least two doses of sclerostin antibody and may, for instance, benefit from a further dosing holiday. In some cases, it may be that the subject is given two, three, four, five, six, seven, or more dosing holidays in the course of their treatment. The administration of at least two doses of the antibody, followed by a dosing holiday, may be referred to as a cycle and in some instances, one, two, three, four, five, six, seven, eight, nine, ten or more such cycles may be used. In other instances, the overall total treatment period may be at least six months, nine months, a year, eighteen months, twenty-four months, or more. It may be that the overall treatment is at least 4, 8, 12, 16, 20, 24, 28, 32, 36, 40, 44, 48 or 52 weeks, or longer, or about such periods. In some instances, where the subject is being treated indefinitely with the antibody, it may be that the approach of batches of doses combined with dosing holidays is continued as long as the treatment lasts. In some instances, it may simply be that a set regimen of a batch doses alternating with dosing holidays is administered. For instance, any combination of those batches and dosing holidays specified herein, for example for two, three, four, five, six or more cycles of a batch of doses followed by a dosing holiday may be administered. In one particularly preferred instance, only the first batch of doses administered comprises the high loading dose(s). In some cases, the duration over which a batch of doses of sclerostin antibody is given may be any of the time values specified above for the duration of treatment. In other instances, the duration a batch of dose(s) of anti-sclerostin antibody is given may be over a shorter duration, particularly where the regimen administered comprises dosing holidays.

In some instances, any of the batches of doses of sclerostin antibody specified herein may be combined with any of the dosing holidays specified herein, as long as the dosing holiday is longer than the interval between doses in a batch. For instance, a batch of doses administered at daily, weekly, fortnightly, four weekly, six weekly or eight weekly intervals may be combined with a dosing holiday of at least six weeks, at least eight weeks, at least twelve weeks, at least 16 weeks, at least 20 weeks or at least 24 weeks, where the dosing holiday is longer than the interval between batches. In some instances, the doses in the batch may be given at about monthly or two monthly intervals and may be combined with a dosing holiday of at least three, four, five, six, eight, ten, twelve or more months in length. In some cases, the batch of doses may comprise three to fourteen doses at daily, weekly, fortnightly, four weekly or six weekly intervals, combined with a dosing holiday of at least six, eight, ten, twelve, fourteen or more weeks in length, where the dosing holiday is longer than the interval between the doses in the batch. In one instance, a batch of monthly doses is combined with a dosing holiday of at least two, three, four, five, six, twelve or more months in length. In some instances, it may be that the doses in the batch are given about every four weeks.

It may be that the length of the dosing holiday given is simply one of the above time periods without reference to the time between administration of earlier doses or the response to earlier doses. For example, the dosing holiday may be six weeks, eight weeks, twelve weeks, sixteen weeks, twenty weeks, twenty four weeks or more in length or any of the other possible lengths referred to. In some cases, it may be that the subject is one administered the batch of doses and then has, at some point, shown a reduced response to sclerostin antibody and so a dosing holiday is applied. In others it may simply be that a dosing holiday is applied after a set number of doses because that would be the number of doses after which it would be likely a reduced response would be expected. It may be that the subject has been administered the antibody for at least about two, three, four, five, six or more months in length as part of the approach provided and hence be identified as a candidate for a dosing holiday. In some cases they may have been administered the antibody for at least about nine, twelve or eighteen months in length and hence be identified as a candidate for a dosing holiday.

A fixed regimen of batch dosing and dosing holiday may be applied in some instances including any of those specified herein, where the approach comprises at least one batch with a loading dose of sclerostin antibody. In an especially preferred embodiment, the first batch of doses administered comprises a loading dose or doses. In one instance, no further batches comprise a loading dose. In another instance, a subsequent batch comprises a loading dose or doses when the subject has been identified as one who would benefit from administration of a loading dose or doses. As discussed above, the dosing holiday approach may also be used in combination with the dosing frequency approach and in some instances all three of the loading dose, dosing frequency and dosing holiday approaches may be employed together.

Responses and Monitoring

The method provided may also comprise monitoring bone markers or properties, for instance to determine whether they would be likely to benefit from administration of loading dose(s) and a more rapid burst of bone formation. Such monitoring may also be used to assess how a treatment is progressing. Monitoring may be performed to determine when a loading dose or doses of sclerostin antibody should be given to a particular subject, for instance because their bone mineral density or other bone markers indicate they are at risk. Monitoring may also be used as a way of determining whether to apply the dosing frequency and/or dosing holiday approaches to a given subject.

In some instances, monitoring may pick up that a subject has suffered a low trauma fracture, in that they have a fracture from an incident that would not normally be expected to result in such a fracture and such monitoring may again be used to identify subjects who would benefit from the approach provided by the present invention. It may be that the subject is one who has suffered a fall that would not normally be expected to result in a fracture in an individual with normal bone density and so again be picked up as a subject who would benefit from the approaches provided. In a particularly preferred embodiment of the invention the subject is one with, or has previously had, a low trauma fracture and it may be that is the reason they have been identified as a subject to apply the invention to.

Such monitoring may be used to determine the size of the response to sclerostin antibody and optionally to determine if the response is reduced compared to that expected and hence whether the subject would benefit from a dosing holiday.

In one instance, such monitoring may be used to determine when to switch over to lower frequency dosing when the dosing frequency approach is employed. For instance, any of the measurements discussed herein may be used to determine when an increase of bone density has been achieved that means a slower rate of bone density increase might then be desirable. Similarly, it may be that the method provided comprises such monitoring to determine when to switchover from loading doses to lower doses. The assessment means discussed herein may also be used to determine suitability for the dosing frequency approach, so subjects that might benefit more from a faster increase of bone density followed by a subsequent lower rate of bone density increase.

Any suitable means of monitoring may be employed. For instance, the level of a bone marker may be measured, in particular a marker of bone formation and/or mineralization may be measured in the subject. Markers of bone resorption may also be measured. Markers indicative of bone resorption (or osteoclast activity) which may be used include, for example, C-telopeptide (e.g., C-terminal telopeptide of type 1 collagen (CTX) or serum cross-linked C-telopeptide), N-telopeptide (N-terminal telopeptide of type 1 collagen (NTX)), deoxypyridinoline (DPD), pyridinoline, urinary hydroxyproline, galactosyl hydroxylysine, and tartrate-resistant acid phosphatase (e.g., serum tartrate-resistant acid phosphatase isoform 5b). Bone formation/mineralization markers which may be used include, but are not limited to, bone-specific alkaline phosphatase (BSAP), peptides released from N- and C-terminal extension of type I procollagen (P1NP, PICP), and osteocalcin (OstCa). Several kits are commercially-available to detect and quantify markers in clinical samples, such as urine and blood. In one preferred instance, the marker used is selected from the serum level of C-telopeptide of type I collagen (CTX), bone-specific alkaline phosphatase (BSAP), osteocalcin (OstCa), and/or N-terminal extension of procollagen type 1 (P1NP). In a preferred instance, such a marker is measured to determine whether to administer loading dose(s). In a further preferred instance, the method provided may comprise measuring such a marker to determine whether to administer a dosing holiday.

In one instance, a bone marker is measured, for instance a bone formation and/or bone resorption marker, particularly any of those referred to herein. In a preferred instance, the bone marker measure is P1NP, in particular P1NP level is measured and preferably serum P1NP level is measured. Other approaches for measuring the effect of treatment and in particular of the sclerostin antibody include assessing bone mineral content and/or bone density. In some instances, the method may comprise measuring bone mineral density (BMD) or bone mineral content (BMC).

Bone mineral density may be, for instance, measured using techniques, such as, single- and dual-energy X-ray absorptometry, ultrasound, computed tomography, radiography, and magnetic resonance imaging. The amount of bone mass may also be calculated from body weights or by using other methods (see Guinness-Hey (1984) *Metab. Bone Dis. Relat. Res.*, 5:177-181). In humans, bone mineral density may be, for instance, determined clinically using dual x-ray absorptiometry (DXA) of, for example, the hip and spine. Other techniques include quantitative computed tomography (QCT), ultrasonography, single-energy x-ray absorptiometry (SXA), and radiographic absorptiometry. Common central skeletal sites for measurement include the spine and hip; peripheral sites include the forearm, finger, wrist and heel. Except for ultrasonography, the American Medical Association notes that BMD techniques typically involve the use of x-rays and are based on the principle that attenuation of the radiation depends on thickness and composition of the tissues in the radiation path. All techniques may employ the comparison of results to a normative database or control subject.

In some instances, the bone mineral density (BMD) of the subject is compared to the peak density of a 30-year old healthy adult (i.e., a "young adult"), creating the so-called "T-score." A patient's BMD also may be compared to an "age-matched" bone density (see, e.g., World Health Organization Scientific Group on the Prevention and Management of Osteoporosis, "Prevention and management of osteoporosis: report of a WHO scientific group." WHO Technical Report Series; 921, Geneva, Switzerland (2000)). The difference between a patient's BMD and that of a healthy, young adult is conventionally referred to in terms of the multiple of a "standard deviation," which typically equals about 10% to about 12% change in bone density. The World Health Organization proposed four diagnostic categories based on BMD T-scores. A BMD value less than 1 standard deviation below that of the young adult reference mean (T-score>-1) is "normal." Low bone mass (osteopenia) is indicated by a BMD value more than 1 standard deviation below the young adult mean, but less than 2.5 standard deviations below (T-score<-1 and >-2.5). A T-score of more than 2.5 standard deviations below the norm supports a diagnosis of osteoporosis.

In one preferred instance, the method provided is applied to subject with such a T-score and in particular loading dose(s) are administered to subject with such a T-score. If a patient additionally suffers from one or more fragility fractures, the patient qualifies as having severe osteoporosis. In a further preferred instance, the subject the method of the invention is applied to has such fractures and in another they are considered at risk of such fractures. In one instance, the subject has both a T-score of less than 2.5 and either has such fractures or is considered at risk of such fractures. Hence, the invention may entail calculating the T-score for the subject, for instance to determine whether to administer loading dose(s). In another embodiment, the invention may additionally or alternatively comprise determining improvement in the T-score following administration of a dose of the sclerostin antibody and in particular may comprise determining whether there is a reduced rate of improvement as an indicator that the subject may benefit from a dosing holiday.

In one instance, any of above mentioned measuring techniques suitable for determining T scores, or assessing the patient, may be employed, for instance dual-energy x-ray absorptiometry (DXA) may be used or in other instances computer tomography (CAT scan) may be employed. Ultrasound, and X rays may also be used, for instance, in subject assessment. In a particularly preferred embodiment DXA is used.

In some cases the method may comprise an initial assessment prior to any sclerostin antibody being given, for instance to determine if the subject would benefit from administration of the loading dose method, the dosing frequency method or both together. It may be, for instance, that the method additionally or alternatively comprises monitoring the subject continuously, for example after each dose of sclerostin antibody. It may be that the subject is monitored, for instance, about once a month, once about every two months, once about every three months, once about every four months, once about every six months or about once a year. It may be that the subject is monitored immediately before a dose is administered and then, for example, about one, two, three, four, five or six weeks later. It may be, for example, that the response seen for at least one, two, three, four, five or more doses is monitored. In some instances, such monitoring or assessment may be performed to determine during a course of treatment to determine any increase in symptoms or drop in bone that means they would benefit from a further batch of doses comprising loading dose(s).

It may be that a dosing holiday is given as part of the method because the subject is displaying a reduced response to administration of sclerostin and it may be that such a dosing holiday will mean that the subject will display a response to sclerostin antibody which is no longer reduced, or at least not so reduced, and is more like a naïve response to sclerostin antibody, particularly the naïve response shown to sclerostin antibody by the subject themselves. The monitoring discussed herein may form part of deciding when to give the subject a dosing holiday, as it may show when the subject is displaying a reduced response to the antibody holiday. In some cases, the dosing holiday may be initiated when the monitoring shows the response is below an expected level for the subject or below a set cut-off value. For instance, the dosing holiday may be initiated when the response to a dose is less than the response seen for an earlier equivalent dose. The response seen may be compared to that expected for a naïve individual given an equivalent dose who has not previously been administered sclerostin.

In some cases, the response to a dose may be measured without any reference to earlier doses and simply the fact it falls below an expected value means a dosing holiday is initiated. Hence, in one instance, the method of the invention may comprise: (a) administering a dose of sclerostin antibody to a subject who has previously been administered sclerostin antibody; (b) measuring the response to the dose; and (c) assessing whether the dose is lower than that expected. If the response is lower than that expected, for instance below a threshold, then a dosing holiday may be given. If the response to the test dose is not though reduced, then the method may optionally comprise administering at least one further dose of the sclerostin antibody to the subject and measuring until a reduced response is seen, then giving a dosing holiday. In some instances, it may be that the subject has already been administered at least three, four, five or six doses before the test dose.

A dosing holiday may include the administration of one or more test doses of sclerostin antibody, where the test dose is used to determine if the resistance displayed to the antibody has diminished or been eliminated. In particular, where the test dose is used to determine whether to terminate the dosing holiday and again begin treatment with the sclerostin antibody or continue the dosing holiday. Hence, in some cases, it may be that the subject may be given a dosing holiday and the end of the dosing holiday may be defined by when the subject displays an increased response to a test dose of sclerostin antibody or, for instance, the subject displays resistance below a defined threshold, such as any of those mentioned herein.

In a preferred instance of any of the embodiments discussed herein, where a test dose is given, what will be monitored, or how the response is defined, will be reference to a bone formation and/or resorption marker, including any of those referred to herein, particularly P1NP levels. In one instance, the subject may be assessed prior to administration of any sclerostin antibody to determine whether or not to employ the method of the invention, for instance to identify if they are a subject who is need of a rapid burst of bone formation.

It may be that the level of the marker is measured before administration of the dose of sclerostin antibody, then, for instance, four, five, six, seven, eight, ten, eleven or twelve days after administration of the test dose. In some cases, rather than determining the response to an individual dose, it may be that any of the parameters referred to herein are measured during a course of treatment to determine if they are less than expected or show a slower, or less marked, increase in the marker. It may be that the subject is assessed clinically to help determine if they are particularly in need of the loading dose approach provided, alternatively or additionally, it may be that such clinical assessment is performed to assess the efficacy of the treatment. It may also be performed as a way to determine when the subject may need a dosing holiday. It may be that the subject has regular checks, such as about monthly, three monthly, four monthly, six monthly or yearly intervals and such checks entail checking or measuring the effect of the sclerostin antibody and/or a dosing holiday, for instance to decide whether to commence a dosing holiday. It may be that any of the assessment techniques discussed herein are used as a way to determine whether the loading dose approach should be applied, for instance because the subject is displaying low bone mineral density so indicating that they might benefit from such a rapid increase in bone mineral density.

Some markers may display diurnal variation, i.e., display variation in their level during the day. Hence, a marker may be measured at a specific time, or time period, in the day. In some instances, where a particular marker is measured more than once, it may be that the marker is measured each time at, or approximately at, the same time in the day, or in about a one hour, two hour, or three hour window. For instance, the marker may be consistently measured in the morning or consistently in the afternoon. In one case, any of the markers measured herein may be measured in such a manner, particularly including those known to show diurnal variation. In some instances, P1NP levels may be measured in such a manner. In some cases, where a marker is measured and compared to a standard, or expected value, the value is measured at a time in the day, or time period, consistent with the standard or expected value.

In some cases monitoring, such as the above discussed approaches, may be used to monitor the rate of bone formation, bone breakdown or the balance between the two.

In some instances, it might be the rate of increase of bone density and/or formation is two, three, four, five or more times that that in the lower dosing period. The same may also be the case, in some instances, where the dosing frequency approach is adopted and the rate during the high frequency dosing and low frequency dosing are compared.

Sclerostin Antibodies

Any suitable sclerostin antibody may be employed in the present invention. The term "antibody" refers to an intact antibody, or a binding fragment thereof. An antibody may comprise a complete antibody (immunoglobulin) molecule (including polyclonal, monoclonal, chimeric, humanized, and/or human versions having full length heavy and/or light chains), or comprise an antigen binding fragment thereof. Antibody fragments include F(ab')2, Fab, Fab', Fv, Fc, and Fd fragments, and can be incorporated into single domain antibodies (e.g., nanobodies), single-chain antibodies, maxibodies, minibodies, intrabodies, diabodies, triabodies, tetrabodies, v-NAR and bis-scFv (see, e.g., Hollinger and Hudson, *Nature Biotechnology*, 23(9):1126-1136 (2005)). Antibody polypeptides, including fibronectin polypeptide monobodies, also are disclosed in U.S. Pat. No. 6,703,199. Other antibody polypeptides are disclosed in U.S. Patent Publication No. 20050238646. U.S. Pat. Nos. 6,395,511 and 6,803,453, and U.S. Patent Publication Nos. 20040009535 and 20050106683 (incorporated in their entirety by reference for their disclosure of sclerostin antibodies) refer to sclerostin antibodies generally. The amino acid sequence of human sclerostin is set forth in SEQ ID NO: 1 of the Sequence Listing and is provided as SEQ ID NO: 1 of U.S. Patent Publication No. 20070110747 (which patent publication is incorporated in its entirety for its description of sclerostin and sclerostin binding agents and Sequence Listing). Sclerostin also is described in Brunkow et al., *Am. J. Hum. Genet.*, 68:577-589 (2001); and Balemans et al., *Hum. Mol. Genet.*, 10:537-543 (2001). Additional information regarding materials and methods for generating sclerostin antibodies can be found in U.S. Patent Publication No. 20040158045 (hereby incorporated by reference in its entirety).

An antibody fragment may be any synthetic or genetically engineered protein. For example, antibody fragments include isolated fragments consisting of the light chain variable region, "Fv" fragments consisting of the variable regions of the heavy and light chains, and recombinant single chain polypeptide molecules in which light and heavy variable regions are connected by a peptide linker (scFv proteins).

The antibody may be any class of antibody, but in a preferred instance the antibody is an IgG antibody.

Another form of an antibody fragment is a peptide comprising one or more complementarity determining regions (CDRs) of an antibody. CDRs (also termed "minimal recognition units" or "hypervariable region") can be obtained by constructing polynucleotides that encode the CDR of interest. Such polynucleotides are prepared, for example, by using the polymerase chain reaction to synthesize the variable region using mRNA of antibody-producing cells as a template (see, for example, Larrick et al., *Methods: A Companion to Methods in Enzymology*, 2:106 (1991); Courtenay-Luck, "Genetic Manipulation of Monoclonal Antibodies," in *Monoclonal Antibodies Production, Engineering and Clinical Application*, Ritter et al. (eds.), page 166, Cambridge University Press (1995); and Ward et al., "Genetic Manipulation and Expression of Antibodies," in *Monoclonal Antibodies: Principles and Applications*, Birch et al., (eds.), page 137, Wiley-Liss, Inc. (1995)).

Sclerostin antibodies may, for instance, bind to sclerostin of SEQ ID NO: 1, or a naturally occurring variant thereof, with an affinity (Kd) of less than or equal to $1\times10^{-7}$ M, less than or equal to $1\times10^{-8}$M, less than or equal to $1\times10^{-9}$M, less than or equal to $1\times10^{-10}$ M, less than or equal to $1\times10^{-11}$ M, or less than or equal to $1\times10^{-12}$M. Affinity is determined using a variety of techniques, an example of which is an affinity ELISA assay. In various embodiments, affinity is determined by a BIAcore assay (a surface plasmon resonance assay). In various embodiments, affinity is determined by a kinetic method. In various embodiments, affinity is determined by an equilibrium/solution method. U.S. Patent Publication No. 20070110747 contains additional description of affinity assays suitable for determining the affinity (Kd) of an antibody for sclerostin.

Sclerostin antibodies for use in the inventive method preferably modulate sclerostin function in the cell-based assay described in U.S. Patent Publication No. 20070110747 and/or the in vivo assay described in U.S. Patent Publication No. 20070110747 and/or bind to one or more of the epitopes described in U.S. Patent Publication No. 20070110747 and/or cross-block the binding of one of the antibodies described in U.S. Patent Publication No. 20070110747 and/or are cross-blocked from binding sclerostin by one of the antibodies described in U.S. Patent Publication No. 20070110747 (incorporated by reference in its entirety and for its description of assays for characterizing an sclerostin antibody).

In various embodiments, the sclerostin antibody binds to a sclerostin polypeptide comprising the amino acid sequence set forth in SEQ ID NO: 1 and binds the sequence of SEQ ID NO: 6 (C4GPARLLPNAIGRGKWWRPSGPDFRC5; corresponding to amino acids 86-111 of SEQ ID NO: 1). Alternatively, or in addition, the sclerostin antibody binds to a sclerostin polypeptide comprising the amino acid sequence set forth in SEQ ID NO: 1 and binds the sequence of at least one of SEQ ID NO: 2 (DVSEYSC1RELHFTR; corresponding to amino acids 51-64 of SEQ ID NO: 1), SEQ ID NO: 3 (SAKPVTELVC3SGQC4GPAR; corresponding to amino acids 73-90 of SEQ ID NO: 1), SEQ ID NO: 4 (WWRPSGPDFRCSIPDRYR; corresponding to amino acids 101-117 of SEQ ID NO: 1), SEQ ID NO: 5 (LVASC7KC8KRLTR; corresponding to amino acids 138-149 of SEQ ID NO: 1), SEQ ID NO: 70 (SAKPVTELVC3SGQC4; corresponding to amino acids 73-86 of SEQ ID NO: 1), SEQ ID NO: 71 (LVASC7KC8; corresponding to amino acids 138-144 of SEQ ID NO: 1), SEQ ID NO: 72 (C1RELHFTR; corresponding to amino acids 57-64 of SEQ ID NO: 1), or SEQ ID NO: 73 (C5IPDRYR; corresponding to amino acids 111-117 of SEQ ID NO: 1) within SEQ ID NO: 1. For example, in one aspect, the sclerostin antibody binds a subregion of sclerostin of SEQ ID NO: 1 comprising SEQ ID NOs: 2-5 (and/or SEQ ID NOs: 70-73), optionally in its native three-dimensional conformation. Optionally, the sclerostin antibody binds a peptide consisting of one or more of SEQ ID NO: 2, SEQ ID NO: 3, SEQ ID NO: 4, SEQ ID NO: 5, SEQ ID NO: 6, SEQ ID NO: 70, SEQ ID NO: 71, SEQ ID NO: 72, or SEQ ID NO: 73 (e.g., a peptide consisting of SEQ ID NO: 2, SEQ ID NO: 3, SEQ ID NO: 4, and SEQ ID NO: 5 or a peptide consisting of SEQ ID NO: 70, SEQ ID NO: 71, SEQ ID NO: 72, and SEQ ID NO: 73).

In various aspects, the sclerostin antibody is capable of neutralizing human sclerostin in a MC3T3 cell-based mineralization assay when there is less than a 6-fold excess of moles of sclerostin binding sites per well as compared to the number of moles of sclerostin per well. Mineralization by osteoblast-lineage cells in culture, either primary cells or cell lines, is used as an in vitro model of bone formation. An exemplary cell-based mineralization assay is described in U.S. Patent Publication No. 20070110747 at, e.g., Example 8 (hereby incorporated by reference). MC3T3-E1 cells (Sudo et al., *J. Cell Biol.*, 96:191-198 (1983)) and subclones of the original cell line can form mineral in culture upon growth in the presence of differentiating agents. Such subclones include MC3T3-E1-BF (Smith et al., *J. Biol. Chem.*, 275:19992-20001 (2000)). For both the MC3T3-E1-BF subclone as well as the original MC3T3-E1 cells, sclerostin can inhibit one or more of the sequence of events leading up to and including mineral deposition (i.e., sclerostin inhibits mineralization). Sclerostin antibodies that are able to neutralize sclerostin's inhibitory activity allow for mineralization of the culture in the presence of sclerostin such that there is a statistically significant increase in, e.g., deposition of calcium phosphate (measured as calcium) as compared to the amount of calcium measured in the sclerostin-only (i.e., no antibody) treatment group.

When running the assay with the goal of determining whether a particular sclerostin antibody can neutralize sclerostin, the amount of sclerostin used in the assay desirably is the minimum amount of sclerostin that causes at least a 70%, statistically significant, reduction in deposition of calcium phosphate (measured as calcium) in the sclerostin-only group, as compared to the amount of calcium measured in the no sclerostin group. An sclerostin neutralizing antibody is defined as one that causes a statistically significant increase in deposition of calcium phosphate (measured as calcium) as compared to the amount of calcium measured in the sclerostin-only (i.e., no antibody) treatment group. To determine whether an sclerostin antibody is neutralizing or not, the amount of sclerostin antibody used in the assay needs to be such that there is an excess of moles of sclerostin binding sites per well as compared to the number of moles of sclerostin per well. Depending on the potency of the antibody, the fold excess that may be required can be 24, 18, 12, 6, 3, or 1.5, and one of skill is familiar with the routine practice of testing more than one concentration of binding agent (antibody). For example, a very potent sclerostin neutralizing antibody will neutralize sclerostin when there is less than a 6-fold excess of moles of sclerostin binding sites per well as compared to the number of moles of sclerostin per well. A less potent sclerostin neutralizing antibody will neutralize sclerostin only at a 12, 18 or 24 fold excess.

The sclerostin antibody optionally has an $IC_{50}$ of 100 nM or less, or 75 nM or less, or 50 nM or less, or 25 nM or less for neutralizing human sclerostin in a cell-based assay, such as a bone specific alkaline phosphatase assay, e.g., the bone specific alkaline phosphatase assay described in International Patent Publication No. WO 2008/115732 and U.S. Pat. No. 7,744,874 (incorporated herein by reference in its entirety for its description of cell-based assays and sclerostin antibodies). The bone specific alkaline phosphatase assay is predicated on the ability of sclerostin to decrease BMP-4 and Wnt3a-stimulated alkaline phosphatase levels in the multipotential murine cell line, C2C12. According to WO 2008/115732, a neutralizing sclerostin antibody mediates a dose-dependent increase of alkaline phosphatase activity in this assay.

Alternatively or in addition, the sclerostin antibody has an $IC_{50}$ of 100 nM or less (e.g., 75 nM or less, or 50 nM or less) for neutralizing human sclerostin in a cell-based Wnt signalling assay in HEK293 cell lines, such as the Wnt assay involving Wnt1-mediated induction of STF reporter gene described in, e.g., International Patent Publication No. WO 2009/047356 (incorporated by reference for its discussion of sclerostin antibodies and cell-based assays). Alternatively or in addition, the sclerostin antibody has an $IC_{50}$ of 500 nM or less (e.g., 250 nM or less, 150 nM or less, 100 nM or less, or 50 nM or less) for neutralizing human sclerostin in a BMP2-induced mineralization assay in MC3T3 cells, such as the mineralization assay described in, e.g., International Patent Publication No. WO 2009/047356.

Examples of sclerostin antibodies suitable for use in the context of the invention are described in U.S. Patent Publication Nos. 20070110747 and 20070072797, which are hereby incorporated by reference. In one embodiment of the invention, the sclerostin antibody cross-blocks the binding of at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, or Ab-24 (all of which are described in U.S. Patent Publication No. 20070110747) to sclerostin. Alternatively or in addition, the sclerostin antibody is cross-blocked from binding to sclerostin by at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, or Ab-24 (all of which are described in U.S. Patent Publication No. 20070110747). The terms "cross-block," "cross-blocked," and "cross-blocking" are used interchangeably herein to mean the ability of an antibody to interfere with the binding of other antibodies to sclerostin. The extent to which an antibody is able to interfere with the binding of another to sclerostin, and therefore whether it can be said to cross-block, can be determined using competition binding assays. In some aspects of the invention, a cross-blocking antibody or fragment thereof reduces sclerostin binding of a reference antibody between about 40% and about 100%, such as about 60% and about 100%, specifically between 70% and 100%, and more specifically between 80% and 100%. A particularly suitable quantitative assay for detecting cross-blocking uses a Biacore machine which measures the extent of interactions using surface plasmon resonance technology. Another suitable quantitative cross-blocking assay uses an ELISA-based approach to measure competition between antibodies in terms of their binding to sclerostin.

Examples of suitable sclerostin antibodies and fragments thereof include antibodies and antibody fragments having one or more of CDR-H1, CDR-H2, CDR-H3, CDR-L1, CDR-L2 and CDR-L3 specifically disclosed in U.S. Patent Publication No. 20070110747. At least one of the regions of CDR-H1, CDR-H2, CDR-H3, CDR-L1, CDR-L2, and CDR-L3 may have at least one amino acid substitution, provided that the antibody retains the binding specificity of the non-substituted CDR. Preferably, the sclerostin antibody is Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, or Ab-24 of U.S. Patent Publication No. 20070110747.

In addition, the sclerostin antibody can comprise at least one CDR sequence having at least 75% identity (e.g., 100% identity) to a CDR selected from SEQ ID NOs: 39, 40, 41, 42, 43, 44, 45, 46, 47, 48, 49, 50, 51, 52, 53, 54, 55, 56, 57, 58, 59, 60, 61, 62, 78, 79, 80, 81, 99, 100, 101, 102, 103, 104, 105, 106, 107, 108, 109, 110, 111, 112, 113, 114, 115, 116, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 351, 352, 353, 358, 359, and 360 provided in the Sequence Listing and disclosed in U.S. Patent Publication No. 20070110747. Preferably, the sclerostin antibody comprises at least one CDR sequence having at least 75% identity to a CDR selected from SEQ ID NOs: 245, 246, 247, 78, 79, 80, 269, 270, 271, 239, 240, and 241, all of which is provided in the Sequence Listing and described in U.S. Patent Publication No. 20070110747. As described in U.S. Patent Publication No. 20070110747, the sclerostin antibody can comprise: a) CDR sequences of SEQ ID NOs:54, 55, and 56 and CDR sequences of SEQ ID NOs:51, 52, and 53; b) CDR sequences of SEQ ID NOs:60, 61, and 62 and CDR sequences of SEQ ID NOs:57, 58, and 59; c) CDR sequences of SEQ ID NOs:48, 49, and 50 and CDR sequences of SEQ ID NOs:45, 46, and 47; d) CDR sequences of SEQ ID NOs:42, 43, and 44 and CDR sequences of SEQ ID NOs:39, 40, and 41; e) CDR sequences of SEQ ID NOs:275, 276, and 277 and CDR sequences of SEQ ID NOs:287, 288, and 289; f) CDR sequences of SEQ ID NOs:278, 279, and 280 and CDR sequences of SEQ ID NOs:290, 291, and 292; g) CDR sequences of SEQ ID NOs:78, 79, and 80 and CDR sequences of SEQ ID NOs: 245, 246, and 247; h) CDR sequences of SEQ ID NOs:81, 99, and 100 and CDR sequences of SEQ ID NOs:248, 249, and 250; i) CDR sequences of SEQ ID NOs:101, 102, and 103 and CDR sequences of SEQ ID NOs:251, 252, and 253; j) CDR sequences of SEQ ID NOs:104, 105, and 106 and CDR sequences of SEQ ID NOs:254, 255, and 256; k) CDR sequences of SEQ ID NOs:107, 108, and 109 and CDR sequences of SEQ ID NOs:257, 258, and 259; l) CDR sequences of SEQ ID NOs:110, 111, and 112 and CDR sequences of SEQ ID NOs:260, 261, and 262; m) CDR sequences of SEQ ID NOs:281, 282, and 283 and CDR sequences of SEQ ID NOs:293, 294, and 295; n) CDR sequences of SEQ ID NOs:113, 114, and 115 and CDR sequences of SEQ ID NOs:263, 264, and 265; o) CDR sequences of SEQ ID NOs:284, 285, and 286 and CDR sequences of SEQ ID NOs:296, 297, and 298; p) CDR sequences of SEQ ID NOs:116, 237, and 238 and CDR sequences of SEQ ID NOs:266, 267, and 268; q) CDR sequences of SEQ ID NOs:239, 240, and 241 and CDR sequences of SEQ ID NOs:269, 270, and 271; r) CDR sequences of SEQ ID NOs:242, 243, and 244 and CDR sequences of SEQ ID NOs:272, 273, and 274; or s) CDR sequences of SEQ ID NOs:351, 352, and 353 and CDR sequences of SEQ ID NOs:358, 359, and 360.

The sclerostin antibody also can comprise at least one CDR sequence having at least 75% identity (e.g., 100% identical) to a CDR selected from CDR-H1, CDR-H2, CDR-H3, CDR-L1, CDR-L2, and CDR-L3 wherein CDR-H1 has the sequence given in SEQ ID NO: 245, CDR-H2 has the sequence given in SEQ ID NO: 246, CDR-H3 has the sequence given in SEQ ID NO: 247, CDR-L1 has the sequence given in SEQ ID NO: 78, CDR-L2 has the sequence given in SEQ ID NO: 79 and CDR-L3 has the sequence given in SEQ ID NO: 80, all of which is provided in the Sequence Listing and described in U.S. Patent Publication No. 20070110747. The sclerostin antibody, in various aspects, comprises two of the CDRs or six of the CDRs. Optionally, the sclerostin antibody comprises heavy chains comprising SEQ ID NO: 378 and light chains comprising SEQ ID NO 376.

The sclerostin antibody also can comprise at least one CDR sequence having at least 75% identity (e.g., 100% identical) to a CDR selected from CDR-H1, CDR-H2, CDR-H3, CDR-L1, CDR-L2, and CDR-L3 wherein CDR-H1 has the sequence given in SEQ ID NO: 269, CDR-H2 has the sequence given in SEQ ID NO: 270, CDR-H3 has the sequence given in SEQ ID NO: 271, CDR-L1 has the sequence given in SEQ ID NO: 239, CDR-L2 has the sequence given in SEQ ID NO: 240 and CDR-L3 has the sequence given in SEQ ID NO 241, all of which is provided in the Sequence Listing and described in U.S. Patent Publication No. 20070110747. The sclerostin antibody, in various aspects, comprises two of the CDRs or six of the CDRs.

Alternatively, the sclerostin antibody can have a heavy chain comprising CDR's H1, H2, and H3 and comprising a polypeptide having the sequence provided in SEQ ID NO: 137 or a variant thereof in which said CDR's are at least 75% identical (e.g., 100% identical) to SEQ ID NO: 245, 246, and 247, respectively, and a light chain comprising CDR's L1, L2 and L3 and comprising a polypeptide having the sequence provided in SEQ ID NO: 133 or a variant thereof in which said CDR's are at least 75% identical (e.g., 100% identical) to SEQ ID NO: 78, 79, and 80, respectively (as described in U.S. Patent Publication No. 20070110747).

The sclerostin antibody may have a heavy chain comprising CDR's H1, H2, and H3 and comprising a polypeptide having the sequence provided in SEQ ID NO: 145 or 392 or a variant thereof in which said CDR's are at least 75% identical (e.g., 100% identical) to SEQ ID NO: 245, 246, and 247, respectively, and a light chain comprising CDR's L1, L2, and L3 and comprising a polypeptide having the sequence provided in SEQ ID NO: 141 or a variant thereof in which said CDR's are at least 75% identical (e.g., 100% identical) to SEQ ID NO: 78, 79, and 80, respectively (as described in U.S. Patent Publication No. 20070110747).

The sclerostin antibody may have a heavy chain comprising CDR's H1, H2, and H3 and comprising a polypeptide having the sequence provided in SEQ ID NO: 335, 331, 345, or 396 or a variant of any of the foregoing in which said CDR's are at least 75% (e.g., 100% identical) identical to SEQ ID NO: 269, 270, and 271, respectively, and a light chain comprising CDR's L1, L2, and L3 and comprising a polypeptide having the sequence provided in SEQ ID NO: 334 or 341 or a variant of any of the foregoing in which said CDR's are at least 75% identical (e.g., 100% identical) to SEQ ID NO: 239, 240, and 241, respectively (as described in U.S. Patent Publication No. 20070110747). All combinations of the heavy and light chain sequences are contemplated (e.g., heavy chains comprising SEQ ID NO: 335 and light chains comprising SEQ ID NO: 334; heavy chains comprising SEQ ID NO: 331 and light chains comprising SEQ ID NO: 334 or 341; and heavy chains comprising SEQ ID NO: 345 or 396 and light chains comprising SEQ ID NO: 341).

Alternatively, the sclerostin antibody has a heavy chain comprising a polypeptide having the sequence provided in SEQ ID NO:137, and a light chain comprising a polypeptide having the sequence provided in SEQ ID NO:133; a heavy chain comprising a polypeptide having the sequence provided in SEQ ID NO:145 or 392, and a light chain comprising a polypeptide having the sequence provided in SEQ ID NO: 141; a heavy chain comprising a polypeptide having the sequence provided in SEQ ID NO:335, and a light chain comprising a polypeptide having the sequence provided in SEQ ID NO:334; a heavy chain comprising a polypeptide having the sequence provided in SEQ ID NO:331, and a light chain comprising a polypeptide having the sequence provided in SEQ ID NO:341; or a heavy chain comprising a polypeptide having the sequence provided in SEQ ID NO:345 or 396, and a light chain comprising a polypeptide having the sequence provided in SEQ ID NO:341 (as described in U.S. Patent Publication No. 20070110747).

Sequences from WO 2008/115732, WO 2009/047356 and WO 2010/130830 have been incorporated into the sequence listing forming part of the present application as filed. Hence: (a) SEQ ID NOs: 397-439 of the sequence listing for the present application correspond to SEQ ID NOs: 1-43 of WO 2008/115732, respectively; (b) SEQ ID NOs: 440-610 of the sequence listing for the present application correspond to SEQ ID NOs: 1-171 of WO 2009/047356, respectively; and (c) SEQ ID NOs: 611-809 of the sequence listing for the present application correspond to SEQ ID NOs: 1-199 of WO 2010/130830, respectively. Any of the sequences of WO 2008/115732, WO 2009/047356 and WO 2010/130830 may be employed in the present invention and where reference is made to employing sequences with particular SEQ ID NOS from WO 2008/115732, WO 2009/047356 and WO 2010/130830, the corresponding sequences given by the sequence listing of the present application may be employed.

Examples of sclerostin antibodies also therefore include, but are not limited to, the sclerostin antibodies disclosed in International Patent Publication Nos. WO 2008/092894, WO 2008/115732, WO 2009/056634, WO 2009/047356, WO 2010/100200, WO 2010/100179, WO 2010/115932, and WO 2010/130830 (each of which is incorporated by reference herein in its entirety, including in particular the sequences provided in the sequence listings of those applications) such as an sclerostin antibody comprising CDRs of SEQ ID NOs: 20-25 of International Patent Publication No. WO 2008/115732 (which correspond to SEQ ID NOs: 416 to 421 of the present application), an sclerostin antibody comprising CDRs of SEQ ID NOs: 26-31 of International Patent Publication No. WO 2008/115732 (which correspond to SEQ ID NOs: 422 to 427 of the present application), an sclerostin antibody comprising CDRs of SEQ ID NOs: 32-37 of International Patent Publication No. WO 2008/115732 (which correspond to SEQ ID NOs: 428 to 433 of the present application), an sclerostin antibody comprising CDRs of SEQ ID NOs: 4, 15, 26, 37, 48, and 59 of International Patent Publication No. WO 2009/047356 (which correspond to SEQ ID NOs: 443, 454, 465, 477, 487 and 498 of the present application), or an sclerostin antibody comprising the amino acid sequence of at least one of SEQ ID NOs: 135-143, 153-161, or 171-179 of International Patent Publication No. WO 2010/130830 (which correspond respectively to SEQ ID NOs: 745-753, 763-771 and 781-789 of the present application).

In one instance, the antibody employed comprises CDRs of SEQ ID NOs: 20-25 of International Patent Publication No. WO 2008/115732 (which correspond to SEQ ID NOs: 416 to 421 of the present application), CDRs of SEQ ID NOs: 26-31 of International Patent Publication No. WO 2008/115732 (which correspond to SEQ ID NOs: 422 to 427 of the present application), or CDRs of SEQ ID NOs: 32-37 of International Patent Publication No. WO 2008/115732 (which correspond to SEQ ID NOs: 428 to 433 of the present application). In another instance, the antibody comprises CDRs of SEQ ID NOs: 4, 15, 26, 37, 48, and 59 of International Patent Publication No. WO 2009/047356 (which correspond to SEQ ID NOs: 443, 454, 465, 477, 487 and 498 of the present application). In a further instance, the antibody comprises the amino acid sequence of at least one of SEQ ID NOs: 135-143, 153-161, or 171-179 of International Patent Publication No. WO 2010/130830 (which correspond respectively to SEQ ID NOs: 745-753, 763-771 and 781-789 of the present application). The disclosure of WO 2008/115732, WO 2009/047356 and WO 2010/130830 is incorporated herein in its entirety, including specifically the referenced CDR sequences and description of antibodies comprising the CDR sequences. Where WO 2008/115732, WO 2009/047356 and WO 2010/130830 refer to employing a particular sequence, the equivalent sequence provided in the sequence listing for the present application may be employed.

In one instance, the antibody employed may be an antibody capable of cross-blocking any of those antibodies specified herein and in particular an antibody that cross-blocks any of Ab-13, Ab-C and Ab-D referred to herein. In this regard, the sclerostin antibody optionally cross-blocks the binding of a second antibody to sclerostin of SEQ ID NO: 1 or is cross-blocked from binding to sclerostin of SEQ ID NO: 1 by the second antibody, wherein the second antibody comprises light chains comprising the amino acid sequence set forth in SEQ ID NO: 205 and heavy chains comprising the amino acid sequence set forth in SEQ ID NO: 209; light chains comprising the amino acid sequence set forth in SEQ ID NO: 15 and heavy chains comprising the amino acid sequence set forth in SEQ ID NO: 19; or light chains comprising the amino acid sequence set forth in SEQ ID NO: 7 and heavy chains comprising the amino acid sequence set forth in SEQ ID NO: 11.

Additional Treatments for Bone Disorders

In some instances, the subject may be administered an additional agent to treat their bone disorder. The subject may be, for instance, treated with any other therapy for treating bone disorders. For example, the additional treatment may be at the same time, overlapping with, or alternating with, the sclerostin antibody treatment of the invention. In one instance, the subject is administered an anti-resorptive, in a particularly preferred instance the additional agent is administered at a time when the subject is not being treated with the sclerostin antibody and in particular during a dosing holiday. In an alternative embodiment, such an agent may be administered at the same time or overlapping with the administration of the sclerostin antibody. In any embodiment discussed herein, the additional agent may be, for instance, vitamin D.

In one instance, the other therapeutic agent may be a bone resorption inhibitor. For instance, any suitable anti-resorptive may be employed. In one preferred instance, the bone resorption inhibitor is a bisphosphonate, particularly a nitrogen containing bisphosphonate. Examples of bisphosphonates include, but are not limited to, Alendronate, bonefos ciodronate, etidronate, ibandronic acid, olpadronate, neridronate, risedronate sodium, skelid, and zoledronic acid. In one preferred instance, the bisphosphonate is zoledronic acid. Bisphosphonates which may be employed include, for instance, Actonel™, Aclasta™/Reclast™, Boniva™/Bonviva™, Fosamax™, and Zometa™. An advantage of alternating between the sclerostin antibody and bisphosphonate is that it may help avoid possible side effects arising from the subject being treated with bisphosphonates for a prolonged period. Hence, alternating helps avoid such side-effects, whilst also addressing the problem of resistance developing to the antibody. In a preferred instance, the additional agent is an anti-resorptive and even more preferably is Alendronate.

Selected estrogen receptor modulators may be employed as bone resorption inhibitors, for instance, arzoxifene, bazedoxifene, FC 1271, lasofoxifene, raloxifene, and Tibolone are examples of suitable SERMs. Other bone resorption inhibitors which may be used include estrogen and calcitonin, with examples of calcitonin including salmon calcitonins, such as Miacalcin™.

Strontium compounds may be employed as the bone resorption inhibitor and in one particular instance the compound is strontium ranelate. In other instances, the additional treatment administered may be PTH, in particular recombinant parathyroid hormone releasing peptide.

In various embodiments, the bone resorption inhibitor is a RANKL inhibitor, such as an anti-RANKL antibody. In one preferred instance, the bone resorption inhibitor employed may be denosumab.

In some instances the anti-resorptive employed is not a bisphosphonate. Examples, of such agents which may be employed include PROLIA®, calcitonin, and cathepsin K inhibitors (e.g., odanacatib).

In various embodiments, the second therapeutic agent is an anabolic agent, such as parathyroid hormone or analogs thereof (e.g., teriparatide (FORTEO®)).

In one case, a bone resorption inhibitor may be administered at the same time, or approximately the same time, as the antibody, or so the two therapies overlap. It may be that the bone resorption inhibitor is given to help prolong further the effect of the sclerostin antibody by reducing the breakdown of bone that the antibody has stimulated and in particular where the compound is a bisphosphonate. In one preferred instance, there is no overlap in the treatment of the subject with sclerostin antibody and the further treatment for the bone disorder, for instance the two treatments are alternated, but never overlap.

In one embodiment of the invention, a batch of doses comprising loading dose(s) is administered because an alternative treatment has not given a big enough increase in bone or is displaying progressively reduced efficacy. In a particular preferred embodiment, administration of sclerostin antibodies is alternated with a different treatment, including any of those mentioned herein.

Disorders to be Treated

The invention is typically used to treat or help prevent a bone disorder. The invention may be, for example, employed to increase at least one of bone formation, bone mineral density, bone mineral content, bone mass, bone quality and bone strength. Hence, in one instance, the disorder to be treated via the invention is a bone disorder associated with at least one of low bone formation, low bone mineral density, low bone mineral content, low bone mass, low bone quality and low bone strength in a mammalian subject.

In one particularly preferred instance, the approach provided is applied to a subject whom would benefit most from an initial rapid rise in bone brought about by administering the initial higher dose(s) of sclerostin antibody or the dosing frequency approach. In one preferred instance, the subject is one who has been recently diagnosed with the disorder, for example within a week, two weeks, four weeks, a month, three months, six months or a year. In a further preferred instance, it may be that the approach provided is the first treatment for the disorder the subject has received since diagnosis, for instance the first treatment following on from diagnosis. In one instance, the approach provided may be the first time that the subject has received sclerostin antibodies as a treatment for the bone disorder. In another instance, the treatment may be the first treatment the subject is given after a fracture occurs, apart from in some instances the basic treatment to treat the fracture, such as application of a cast. In one particularly preferred instance, the approach provided is applied to a subject with a low trauma fracture. For instance, the subject may be one with a fracture from an incident which would not normally incur a fracture in a subject with normal bone density. It may be that the subject has had a fall that would not normally result in a fracture in a subject with normal bone mineral density, but has in the subject.

In some cases, it may be that the approach provided is applied to a subject because they are displaying a fracture or low bone density indicating that the subject would benefit from the initial rapid increase in bone mineral density brought about by employing the loading dosing approach. For instance, the subject may display a drop in any of the bone markers discussed herein, particularly a drop indicating the subject is at risk. It may be that the subject has experienced an increase in severity of the disorder and so would benefit from the approach provided. In some instances, the approach provided may comprise assessing a given subject to identify a time point when they are most in need of the loading dose approach and then applying it to them.

The disorder may be a bone-related disorder associated with abnormal osteoblast or osteoclast activity. Examples of disorders associated with bone loss which may be treated include achondroplasia, cleidocranial dysostosis, enchondromatosis, fibrous dysplasia, Gaucher's Disease, hypophosphatemic rickets, Marfan's syndrome, multiple hereditary exotoses, neurofibromatosis, osteogenesis imperfecta, osteopetrosis, osteopoikilosis, sclerotic lesions, pseudoarthrosis, pyogenic osteomyelitis, periodontal disease, anti-epileptic drug induced bone loss, primary and secondary hyperparathyroidism, familial hyperparathyroidism syndromes, weightlessness induced bone loss, osteoporosis in men, postmenopausal bone loss, osteoarthritis, renal osteodystrophy, infiltrative disorders of bone, oral bone loss, osteonecrosis of the jaw, juvenile Paget's disease, melorheostosis, metabolic bone diseases, mastocytosis, sickle cell anemia/disease, organ transplant related bone loss, kidney transplant related bone loss, systemic lupus erythematosus, ankylosing spondylitis, epilepsy, juvenile arthritides, thalassemia, mucopolysaccharidoses, Fabry Disease, Turner Syndrome, Down Syndrome, Klinefelter Syndrome, leprosy, Perthe's Disease, adolescent idiopathic scoliosis, infantile onset multi-system inflammatory disease, Winchester Syndrome, Menkes Disease, Wilson's Disease, ischemic bone disease (such as Legg-Calve-Perthes disease and regional migratory osteoporosis), anemic states, conditions caused by steroids, glucocorticoid-induced bone loss, heparin-induced bone loss, bone marrow disorders, scurvy, malnutrition, calcium deficiency, osteoporosis, osteopenia, alcoholism, chronic liver disease, postmenopausal state, chronic inflammatory conditions, rheumatoid arthritis, inflammatory bowel disease, ulcerative colitis, inflammatory colitis, Crohn's disease, oligomenorrhea, amenorrhea, diabetes mellitus, hyperthyroidism, thyroid disorders, parathyroid disorders, Cushing's disease, acromegaly, hypogonadism, immobilization or disuse, reflex sympathetic dystrophy syndrome, regional osteoporosis, osteomalacia, bone loss associated with joint replacement, HIV associated bone loss, bone loss associated with loss of growth hormone, bone loss associated with cystic fibrosis, chemotherapy-associated bone loss, tumor-induced bone loss, cancer-related bone loss, hormone ablative bone loss, multiple myeloma, drug-induced bone loss, anorexia nervosa, disease-associated facial bone loss, disease-associated cranial bone loss, disease-associated bone loss of the jaw, disease-associated bone loss of the skull, bone loss associated with aging, facial bone loss associated with aging, cranial bone loss associated with aging, jaw bone loss associated with aging, skull bone loss associated with aging, and bone loss associated with space travel. Bone loss, decreased bone mineral density, decreased bone volume, and/or decreased bone mineral content associated with these disorders may be treated in the context of the invention. In one instance, the subject to be treated may be pregnant. For instance, the invention may be employed to help in pregnancy-related bone loss. The invention may be used to slow, or reverse, bone loss in general.

In one particularly preferred instance, the condition to be treated is osteoporosis or osteopenia. In one instance, the subject to be treated is a postmenopausal woman, for instance, one with osteoporosis, particularly such a subject who is at increased, or high risk, for fracture, or has failed or is intolerant to other available osteoporosis therapy. In further instances, the invention may be employed in improving the outcome in a mammal undergoing one or more of an orthopedic procedure, dental procedure, implant surgery, joint replacement, bone grafting, bone cosmetic surgery and bone repair such as fracture healing, nonunion healing, delayed union healing and facial reconstruction.

In one preferred instance, the subject has, or is thought at risk of, a bone fracture. For instance, it may be that the subject has a bone mineral density that identifies them at risk of bone fracture. It may be that the subject has recently been diagnosed with a bone disorder as a result of a bone fracture. In some instances, it may be that the subject has a fracture of the wrist, arm, leg, hip or vertebrae and in some cases it may be that the fracture has resulted in the diagnosis of the bone disorder. In one instance, the subject has a fracture and the treatment period begins within about two weeks, one week, less than one week or less than five days of the fracture, for example within five, four, three, two or one days of the fracture occurring. In an alternative instance, it may be that the subject is not one with a bone fracture and/or is not at risk of bone fractures.

Administration and Other Aspects

The agents discussed herein may be administered via any suitable route, including via any of those discussed herein, where appropriate for a particular agent.

Various routes of administering an antibody to a subject are known in the art and discussed in, e.g., U.S. Patent Publication No. 20070110747. For example, in various embodiments, it is desirable to deliver a pharmaceutical composition comprising the sclerostin antibody subcutaneously, parenterally, intravenously, intramuscularly, or even intraperitoneally. Such approaches are well known to the skilled artisan, some of which are further described, for example, in U.S. Pat. Nos. 5,543,158; 5,641,515; and 5,399,363. Optionally, the sclerostin antibody is administered subcutaneously.

In a particularly preferred instance, the loading dose(s) are administered intravenously via an injection or infusion and preferably via an intravenous infusion. In one instance the lower subsequent doses are given via subcutaneous injection. In one preferred embodiment, those two instances are combined. For instance, at least one and preferably all of the loading dose(s) are administered via intravenous injection, preferably by an infusion, and the subsequent doses are administered via subcutaneous injection. In one preferred instance, all of the loading dose(s) are administered intravenously, preferably via an infusion, and all of the subsequent lower doses are administered subcutaneously. In one instance, all, or the majority of, the dose(s) given to the subject are administered subcutaneously. In another instance, all, or a majority of, the dose(s) given to the subject are administered intravenously.

In one instance, the subject is given an annual intravenous infusion as part of the dosing regimen, for instance it may be that a single loading dose is given once a year as an intravenous infusion and that forms part of the dosing regimen administered. In other instances, it may be that such an infusion is given once every six to eighteen months as part of the regimen. It may be that a loading dose is given once about every six, seven, eight, nine, ten, eleven, twelve, thirteen or fourteen months or an interval within a range having any of those values as endpoints.

Illustrative physiologically-acceptable (e.g., pharmaceutical) forms suitable for use include sterile aqueous solutions or dispersions and sterile powders for the extemporaneous preparation of sterile injectable solutions or dispersions (for example, see U.S. Pat. No. 5,466,468). The form must be sterile and is desirably fluid to the extent that easy syringability exists (i.e., is not excessively viscous so as to prevent passage through a syringe). The form may be one suitable for any of the routes discussed above, or for at least one of them. A pharmaceutical composition comprising the sclerostin antibody may be placed within containers (e.g., vials or syringes), along with packaging material that provides instructions regarding the use of such pharmaceutical compositions. Generally, such instructions will include a tangible expression describing the reagent concentration, as well as within certain embodiments, relative amounts of excipient ingredients or diluents (e.g., water, saline or PBS) that may be necessary to reconstitute the pharmaceutical composition. In one instance, where the antibody is to be administered with an additional treatment for the bone disorder, the two may be formulated or packaged together, optionally with instructions setting out a method of the invention. The present application also provides a kit comprising a pharmaceutical composition comprising an sclerostin antibody and instructions for administering the antibody via a regimen provided herein. The kit may comprise a second reagent for treating the bone disorder, including any of the second agents and bone disorders referred to herein. In other instance, the kit may not comprise such a second agent.

In any of the instances herein where a method is referred to herein, the invention also provides an sclerostin antibody for use in such a method. The invention also provides for use of an sclerostin in the manufacture of a medicament for treating any of the conditions mentioned herein. In instances where two agents are administered together, the invention allows for simultaneous, sequential or separate administration.

All of the references cited herein, including patents, patent applications, literature publications, and the like, are hereby incorporated by reference.

While this invention has been described with an emphasis upon preferred embodiments, it will be obvious to those of ordinary skill in the art that variations of the preferred compounds and methods may be used and that it is intended that the invention may be practiced otherwise than as specifically described herein. Accordingly, this invention includes all modifications encompassed within the spirit and scope of the invention as defined by the following claims.

The invention is further described in the following Examples. The Example serves only to illustrate the invention and is not intended to limit the scope of the invention in any way.

EXAMPLES

Example 1

Materials and Methods

Mice

Female Balb/c mice were used in all experiments in Example 1 and were supplied by Charles River, 8-10 weeks old at start of experiments. Mice were housed in cages in an environmentally controlled room (temperature 21° C. to 23° C. and relative humidity 38% to 50% on a 12-hour light/dark cycle according to UK Home Office regulations). Animals had access to RM1 food pellets (Lillico) and water ad libitum. Animals were acclimatised for a minimum of one week before use. All animal experiments were performed in agreement with UK guidelines (Animals (Scientific Procedures) Act 1986. Scl-AbI (Eddleston et al (2009) *J Bone Miner Res.*, 24:1662-71) was administered at 10 mg/kg s.c. weekly (unless otherwise stated). All experiments referred to herein employed the Scl-AbI antibody. Phosphate buffered saline (PBS) was administered s.c. to control groups whenever Scl-AbI was administered. Alendronate (sodium trihydrate from Sigma) was dosed weekly (0.2 mg/kg s.c.). P1NP (Procollagen type 1) was measured using a competitive ELISA kit (AC-33F1) from ImmunoDiagnostic Systems according to manufacturer's recommendations. Peak P1NP levels were routinely measured 4 days after antibody dosing. Plasma levels of Scl-AbI were measured using an antigen-binding ELISA. Bone mineral density (BMD) was measured using a LUNAR PIXImus DXA scanner.

Bone RNA Isolation.

Left and right femurs isolated from mice were cleaned of soft tissue before removal of the proximal and distal epiphyseal regions. The remaining diaphysis region was flushed with 2 ml cold PBS using a needle to remove bone marrow and the femur shaft was flash frozen in liquid nitrogen. Left, or right, femurs were pooled (n=4/group) and total RNA isolated via 2×3 minutes homogenisation in 1 ml Qiazol lysis reagent (Qiagen) using 5 mm stainless steel beads (Qiagen) and TissueLyser II (Qiagen). Following the addition of chloroform, samples were centrifuged (12,000 g for 15 minutes at 4° C.) and the aqueous phase retained and RNA therein precipitated by the addition of propan-2-ol and centrifugation (12,000 g for 10 minutes at 4° C.). Total RNA extracted in this way was further purified using RNeasy Plus Mini kit (Qiagen) as per the manufacturer's instructions.

Quantitative Real-Time RT-PCR (TaqMan)

A two-step TaqMan protocol was used. RNA was reverse transcribed using SuperScript VILO cDNA synthesis kit (Life Technologies) in accordance with the manufacturer's instructions. TaqMan PCR was performed in triplicate wells using TaqMan Gene Expression Master Mix (Life Technologies) with 1 µl cDNA/well from each left or right femur pool. No RT and no template control wells were included in each experiment. The ΔΔCt method was used to normalise expression against the geometric mean of Eif3f and Psmd4, which were reported as being constitutively expressed housekeeping genes in a range of tissues by Kouadjo et al (2007) *BMC Genomics*, 8:127. Data from left, or right, femur pools for each animal group were normalised relative to transcript abundances observed in the group receiving a single dose of Scl-AbI and this combined data plotted to show relative transcript abundance in both femurs of each group. Comparisons of data were performed using T test or one-way ANOVA with post-hoc test at each time point.

Results

FIG. 1A (solid line) shows circulating P1NP levels over a 32 day period in a group of control female BALB/c mice dosed weekly with PBS. These mice showed no acute changes in P1NP levels in response to weekly dosing with PBS, however mean P1NP levels fell slightly during the course of the experiment, consistent with reduced bone formation as the mice approached skeletal maturity. A large P1NP change in P1NP levels was observed in mice receiving Scl-AbI for the first time (Scl-AbI-naïve mice) on either day 14 or day 28 of the experiment (shown by the dashed lines in FIG. 1A (P1NP levels are shown pre-dose and 4 days post-dose). However, the P1NP levels four days after exposure to Scl-AbI in age-matched mice previously exposed to Scl-AbI (shown by the dotted lines in FIG. 1A) was significantly lower than that seen in age-matched Scl-AbI-naïve mice. This difference was significant after two (day 14) and after four (day 28) previous administrations of Scl-AbI.

To further investigate this difference in the P1NP response to Scl-AbI, we compared the kinetics of the increase in P1NP in mice with different levels of prior exposure to Scl-AbI. FIG. 1B (dashed black line) shows the P1NP response to Scl-AbI in 8-10 week old antibody-naïve mice. The peak response occurred 4 days after dosing and declined to near baseline 7 days post dose. A similar time course was seen in animals that are 5 weeks older irrespective of whether they were Scl-AbI-naïve (dashed grey line) or had previously received multiple doses of the Scl-AbI (solid black line). Consistent with the data in FIG. 1A, the peak circulating P1NP levels in the multiply-dosed group were significantly lower than the levels in the mice dosed with the antibody for the first time. A five-fold higher dose of antibody (50 mg/kg s.c.) given at day 35 to an age-matched multiply-dosed group of animals produced a significantly higher peak P1NP response than in multiply-dosed animals given 10 mg/kg of the antibody (mean 61 ng/ml vs 47.5 ng/ml, p<0.05) but this response was still significantly less than was seen in age-matched antibody-naïve animals dosed with 10 mg/kg of Scl-AbI (88.4 ng/ml, p<0.01).

To exclude the possibility that the multiply-dosed mice in FIG. 1A had mounted an immune response that cleared or neutralised the Scl-AbI, an examination was carried out of the levels of antibody capable of sclerostin binding at days 28 (pre-dose) and 32 in Scl-AbI-naïve mice and mice that had previously received multiple doses of the antibody. FIG. 1C shows that the Scl-AbI levels were not significantly different between the two groups. Scl-AbI has a relatively short half-life in mice (FIG. 1D) and would not be expected to accumulate with weekly dosing. These data indicate that the significant difference in P1NP levels four days after Scl-AbI treatment in Scl-AbI-naïve mice compared with the levels in age-matched multiply-dosed animals was not due to differences in antibody exposure or to changes in the kinetics of P1NP production following multiple doses of antibody. The data indicates that after multiple exposures to Scl-AbI mice produce an attenuated P1NP response.

P1NP is produced when type 1 collagen is processed during deposition of collagen fibrils as part of osteoid formation. To determine if the attenuated P1NP response after multiple exposures to Scl-AbI was due to reduced transcription of collagen, Col1a1 mRNA transcript abundance was compared in femurs of mice that had been dosed with PBS (striped bar), a single dose of Scl-AbI (grey bar) or multiple doses of the antibody (black bar). FIG. 1E shows that Col1a1 mRNA levels in mice administered a single dose of Scl-AbI were significantly higher than in age-matched mice dosed with PBS but after multiple Scl-AbI administrations, age-matched mice had significantly lower Col1A1 mRNA levels than those seen in mice exposed to Scl-AbI for the first time. These data are consistent with the smaller increases in P1NP observed after multiple doses of Scl-AbI compared with the increase in P1NP seen after the first dose of Scl-AbI and are suggestive of reduced osteoid formation.

To determine if the attenuated response to Scl-AbI seen after multiple doses of the antibody was reversible, the experiment shown in FIG. 1A was extended as shown in FIG. 2A. Mice that had been exposed to multiple doses of Scl-AbI were left without further Scl-AbI dosing for an 8 week period, after which the mice were re-dosed with Scl-AbI (10 mg/kg, s.c. given on day 84). FIG. 2A shows that 4 days after dosing with Scl-AbI the mean P1NP level in this group of animals (which had shown an attenuated P1NP response at day 32 compared to Scl-AbI-naïve mice) was not significantly different from the mean level in a group of aged-matched Scl-AbI-naïve mice dosed with Scl-AbI for the first time on day 84. This indicates that the attenuation of the P1NP response seen after dosing on day 28 was reversed after the dose-free interval. FIG. 2A also shows that after another series of doses of Scl-AbI (on days 84, 91, 98, 105, 112), P1NP levels on day 123 in these multiply Scl-AbI dosed mice were significantly lower than the levels in age-matched antibody-naïve mice dosed for the first time, showing that an attenuated response to the antibody had again developed after multiple exposures to the antibody. This attenuation was lost after a further dose-free period (from day 112 to day 175) as shown by the very similar levels of P1NP at day 179 in animals that had recently received multiple doses of Scl-AbI and aged-matched Scl-AbI-naïve animals.

The animals dosed repeatedly with the Scl-AbI in FIG. 2A were monitored for changes in whole body BMD (shown in FIG. 2B) throughout the experiment. As expected, there was a rapid increase in BMD between the start of the experiment and day 28. However, consistent with the observed P1NP response, the initial rapid rate of increase in BMD appeared to slow somewhat towards the end of the first dosing interval (between days 14 and 28). Following the cessation of Scl-AbI dosing (day 28), BMD declined until Scl-AbI dosing restarted (day 84). From this point there was again a rapid rise in BMD until the end of the dosing interval at day 112 at which point BMD again started to decline.

As shown in FIG. 2A, a dose-free period of 8 weeks resulted in a reversal of the attenuated P1NP production in mice administered multiple doses of Scl-AbI. FIG. 3A shows that a shorter dose-free period is also able to reverse the attenuated P1NP response in multiply-dosed animals. In this experiment, animals were dosed 5 times at weekly intervals (days 0, 7, 14, 21 and 28) with Scl-AbI and, as expected, circulating P1NP levels were significantly lower 4 days after the fifth dose of Scl-AbI when compared with the P1NP levels in Scl-AbI-naïve animals exposed to the antibody for the first time (see P1NP levels at day 32 in multiply-dosed (open diamond) and Scl-AbI naïve animals (black diamond) in FIG. 3A). Subgroups of the multiply-dosed animals were given dose-free intervals of 14, 28 and 42 days and then their P1NP response was compared with that of aged-matched animals exposed to the Scl-AbI for the first time. The Figure shows that after a dose-free interval of 4 weeks the response in the multiply dosed animals was not significantly different from that in age-matched Scl-AbI-naïve animals.

Administration of an antibody to sclerostin is believed to increase bone formation, at least in part, by increasing signalling through the Wnt signalling pathway.

Increased Wnt signalling has been shown in some circumstances to activate a feedback mechanism that increases expression from Wnt-responsive genes of molecules that are capable of down-regulating Wnt signalling (Niida et al (2004) *Oncogene,* 23:8520-6 and Reguart et al (2004) *Biochem Biophys Res Commun.* 2004; 323:229-34). In order to investigate if this was involved in the attenuated P1NP response observed after multiple doses of Scl-AbI, the levels of mRNA encoding a range of soluble Wnt regulatory molecules in the femurs of age-matched mice dosed five times with PBS or Scl-AbI were studied. Expression levels were quantified by TaqMan PCR relative to the levels of two stably expressed housekeeping genes (Eif3f and Psmd4 (Kouajo et al, 2007, supra)) as shown in FIG. 3B. All of the soluble Wnt regulatory molecules measured were significantly elevated in the animals dosed with Scl-AbI except sFRP1. The mRNA levels of Rpl38, a gene not involved in Wnt signaling and reported to be stably expressed in bone (Kouajo et al, 2007, supra), did not change significantly in response to Scl-AbI exposure.

Since the rate of increase in BMD was greatest soon after the initial exposure to Scl-AbI, it was of interest to determine if the size of the initial dose of antibody was important in determining the long-term effects of Scl-AbI on whole body BMD. FIG. 4A compares the whole body BMD in mice dosed with PBS versus two groups of animals, which received either 10 mg/kg Scl-AbI s.c. weekly throughout the experiment (dotted black line) or were administered a large initial dose of the same antibody (50 mg/kg s.c.) followed by weekly doses at 10 mg/kg s.c. (solid black line). The animals dosed initially with 50 mg/kg showed a more rapid increase in BMD than those receiving an initial dose of 50 mg/kg and had a significantly higher whole body BMD on days 14 and 28, however, over time both groups had similar bone density gains.

In an effort to maximise the effect of Scl-AbI on BMD in mice an intermittent dosing regimen was investigated. This regimen involved periods of antibody dosing interspersed with periods "off-treatment" to allow recovery of a full bone formation response to the antibody. FIG. 4B compares the effects of such an intermittent dosing regimen with a regimen involving weekly doses antibody with no "off-treatment" periods. In this experiment, 3 groups of mice were exposed to different Scl-AbI dosing regimens. The first group was dosed weekly throughout the experiment with 10 mg/kg Scl-AbI (solid line), and the second group of age-matched animals was dosed according to a regimen that involved 5 weekly doses of Scl-AbI (10 mg/kg) followed by 4 weekly doses of PBS (dashed line). Based on previously described experiments (FIG. 3A) it was expected that after 5 weeks of dosing with the antibody attenuated bone formation would have developed but that this attenuated response would reverse during the period of PBS dosing. The third group of age-matched animals (shown by dash/dotted line) were dosed according to a regimen that involved 5 weekly doses of Scl-AbI (10 mg/kg s.c.) followed by 4 doses of the antiresorptive drug alendronate (0.2 mg/kg s.c. weekly), this regimen was repeated through day 221. The dose of alendronate used was selected because it mildly increased bone mass in mice when used alone, but did not to attenuate the P1NP response after subsequent administration of Scl-AbI. This group was included to determine if an antiresorptive agent could be used to reduce any bone resorption that might occur when Scl-AbI was no longer present. As can be seen in FIG. 4B the animals dosed with weekly doses of Scl-Ab throughout the experiment showed a large increase in BMD with the rate of increase being most rapid during the first five weeks of dosing. The BMD in mice administered alternating periods of dosing with Scl-AbI and PBS showed a "sawtooth" pattern of BMD changes, with BMD increasing rapidly during periods of Scl-AbI administration and falling during periods of dosing with PBS. The group of mice administered alternating periods of Scl-AbI and alendronate showed a less pronounced "sawtooth" pattern to their BMD accumulation with alendronate reducing the bone loss after antibody administration. At the end of the experiment the mice dosed with alternating periods of Scl-AbI and alendronate had a bone density that was not significantly different from those mice dosed continuously with Scl-Ab and was significantly higher than mice dosed with alternating periods of Scl-AbI and PBS.

Discussion

The attenuation of bone formation that develops after multiple sclerostin antibody exposures raises questions about the most effective dosing regimen for increasing bone mineral dosing (BMD). The results presented here demonstrate that an initial high loading dose of sclerostin antibody, followed by a lower dose, brings about an initial rapid rise in BMD followed by a slower rise in BMD. In particular, mice given a large first dose of antibody (50 mg/kg loading dose) followed by weekly doses of 10 mg/kg had significantly higher whole body BMD by day 14 than mice dosed weekly with 10 mg/kg of sclerostin antibody from the start of the experiment. However, the rate of increase in BMD in the mice given the initial 50 mg/kg loading dose of antibody slowed more rapidly than in the mice given the weekly 10 mg/kg dose and from day 42 there was no longer a significant difference in BMD between the two groups. Thus, by giving an initial high dose of sclerostin, followed by smaller subsequent doses, an initial rapid period of bone generation can be followed by a slower rate. This may be particularly useful in treating individuals with bone disorders with a very low BMD, where an initial rapid increase of BMD is desired, for instance because they are at risk due to their low BMD. It may also prove a more cost-effective treatment, because after the loading dose(s) the subsequent dose(s) are lower and so require less antibody.

The results also illustrate the usefulness of a "dosing holiday" in a treatment regimen, where a subject is given a break from sclerostin antibody treatment, to help reverse the reduced effect of sclerostin antibodies on BMD that develops after multiple administrations of such antibodies. The results show that administering a different agent able to increase BMD during the dosing holiday from the sclerostin antibody, particularly an anti-resorptive, is a very effective way for continuously increasing BMD. Hence, FIG. 4B shows that the group of mice that were dosed with alternating periods of sclerostin antibody and periods of the anti-resorptive drug alendronate showed a less pronounced "sawtooth" pattern of BMD and at end of the experiment was not significantly different from the BMD in mice dosed weekly with sclerostin antibody throughout the experiment. The alendronate reduces the bone loss and helps to maintain BMD during the dosing holidays when sclerostin antibody is not being administered.

The results presented also illustrate the role of wnt signalling. FIG. 3B shows that after repeated administration of Scl-Ab mRNAs encoding multiple extracellular inhibitors of Wnt signalling (including the Sost gene, which encodes sclerostin) were significantly upregulated. It is unlikely that the increased synthesis of sclerostin alone was responsible for the attenuated P1NP response seen here since a 5-fold higher dose of Scl-AbI was unable to fully restore the P1NP response in multiply-dosed animals to that seen in age-matched antibody-naïve mice dosed with the antibody for the first time. However, increases in other soluble Wnt regulatory molecules in the multiply-dosed animals may have significantly contributed to a down-regulation of Wnt signalling, resulting in an attenuated bone formation response. Although it was not assessed directly in this study, a period free of antibody dosing would be expected to allow the "normalisation" of levels of Wnt regulators and allow for the restoration of a P1NP response to sclerostin antibody that was comparable to that observed in antibody-naïve animals.

Figure 2:
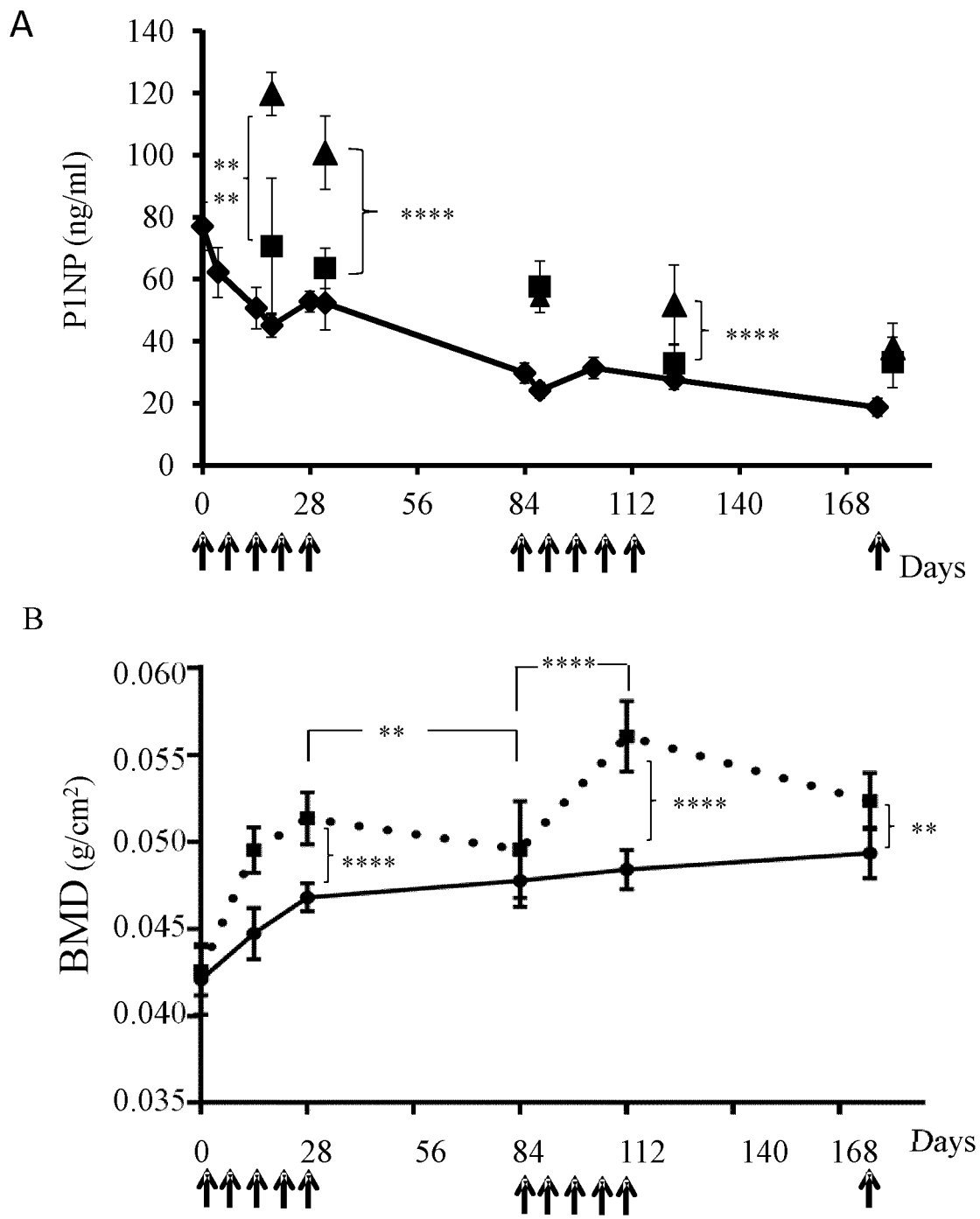

In mice, the absolute magnitude of the increase in bone formation (measured by circulating P1NP levels) in response to sclerostin antibody appears to decline as the mice age (FIG. 2). However, this change with age is less marked if viewed as a percentage change from the baseline P1NP value (which falls as the mice age). It is important to note that administration of antibodies to sclerostin can still generate robust increases in BMD in aged mice.

Example 2

Six month old Sprague Dawley rats were employed in the work described in this Example. At four months of age the rats were either ovariectomised (OVX rats) or given a sham ovariectomy (sham rats). Following on from the surgery, two months later the rats were given a dosing regimen divided into a "first period" and a "second period". The rats were split into several groups, with the treatments given to the different groups of rats summarized in Table 1 below, with more information also provided in Table 2 below. Rats were sacrificed at various time points to allow a more detailed analysis of the bones. Some of the rats were sacrificed immediately after the "first period" of the dosing regimen (Table 2 in the column "Necropsy at week 6 (n)" indicates which treatment groups the sacrificed rats originate from);

further rats, designated "Arm-2" rats, were sacrificed six weeks into the "second period" of dosing, so 12 weeks overall into the dosing regimen (Table 2 in the column "Necropsy at week 12 (n)" indicates which treatment groups the sacrificed rats originate from); and further rats, designated "Arm-1" rats, were sacrificed 20 weeks into the "second period" of dosing, so 26 weeks overall into the dosing regimen (Table 2 in the column "Necropsy at week 26 (n)" indicates which treatment groups the sacrificed rats originate from).

TABLE 1

| | First Period (6 weeks) | Second Period Arm-2 = 6 weeks Arm -1 = 20 weeks |
|---|---|---|
| Arm-1 and Arm-2 | Sham OVX OVX + Scl-Ab - once a week OVX + Scl-Ab - once a week OVX + Scl-Ab - once a week | Sham OVX OVX + Scl-Ab - once a week OVX + Vehicle only OVX + OPG - twice a week |
| Arm-1 only | OVX + Scl-Ab - once a week | OVX + Scl-Ab - once every four weeks |

The abbreviations in Table 1 are: "Sham"—sham ovariectomised rat; "OVX" for ovariectomised rat; "Scl-Ab" for sclerostin antibody; and "OPG" for osteoprotegerin an endogenous decoy receptor inhibiting RANKL signaling.

Serum collection and bone mineral density (BMD) were taken at BL, 3, 6, 9, 12, 15, 18, 22 and 26 weeks from the start of the experiment.

FIGS. 5 to 8 show the bone mineral density results obtained for the "Arm-1" rats. The results depicted in FIGS. 5 to 8 are bone density measurements for "Arm-1":

FIG. 5 shows vertebral bone mineral density (BMD) in g/cm$^2$;

FIG. 6 shows percentage change from baseline in vertebral bone mineral density (BMD);

FIG. 7 Femur-Tibia bone mineral density (BMD) in g/cm$^2$; and

FIG. 8 shows percentage change from baseline in Femur-Tibia (BMD).

The "Switch" time point in all of FIGS. 5 to 8 is the swap over from the first period of six weeks to the second period of 20 weeks for the Arm-1 rats. All of the treatment groups showed a significant difference from the control ovariectomised rats treated with vehicle alone at all time points (mean+/−SEM).

TABLE 2

Group Information

| | BL 8 wks after ovariectomy | First Period (6 weeks) | Necropsy at week 6 (n) | Second period (20 weeks) | Necropsy at week 12 (n) | Necropsy at week 26 (n) |
|---|---|---|---|---|---|---|
| Sham + vehicle | 10 | Vehicle (twice a week) | 12 | Vehicle (twice a week) | 12 | 12 |
| OVX + Vehicle | 10 | (twice a week) | 12 | Vehicle (twice a week) | 12 | 12 |
| OVX + Scl-AbIII | | Scl-AbIII 25 mg/kg (once a week) | 12 | Scl-AbIII (once a week) | 12 | 12 |
| OVX + Scl-AbIII then Vehicle | | Scl-AbIII 25 mg/kg (once a week) | | Vehicle (twice a week) | 12 | 12 |
| OVX + Scl-AbIII then OPG | | Scl-AbIII 25 mg/kg (once a week) | | OPG 10 mg/kg (twice a week) | 12 | 16 |
| OVX + Scl-AbIII once a week, then Scl-AbIII every four weeks | | Scl-AbIII 25 mg/kg (once a week) | | Scl-AbIII (once every four weeks) | | 12 |

▲ ARM-1

The bone mineral density results obtained shown in FIGS. 5 to 8 illustrate that:

in the group administered sclerostin antibody once a week in the first period and then vehicle once a week in the second period (the black triangles in the Figures), after the switchover a gradual decrease in bone mineral density (BMD) was seen;

in the group administered sclerostin antibody once a week in the first period and then sclerostin antibody once every four weeks in the second period (the black squares) did not display any decrease in bone mineral density (BMD);

that group with the less frequent once every four weeks dosing of sclerostin antibody in the second period displays a similar low level of bone formation after the switchover as the group administered sclerostin antibody for the first period and then the RANKL inhibitor OPG; and the group with the less frequent dosing in the second period with sclerostin antibody given every four weeks, offered an intermediate position between the group given only vehicle in the second period and the group given weekly dosing of sclerostin antibody in both the first and second periods (unfilled triangles in the Figures).

FIG. 9 shows measurement of three separate serum biomarkers which are serum PINP (panel (A) in the Figure), serum osteocalcin (panel (B) in the Figure) and Tracp 5b (panel (C) in the Figure. The groups of rats shown are, going from top to bottom in the key to each panel are:

sham ovariectomised rats ("sham"—open circle, broken line);

ovariectomised rats given vehicle for both the first and second period a ("OVX+Veh"—dark grey squares, broken line);

ovariectomised rats given sclerostin antibody once a week for both the first and second periods ("OVX+SAB Qwk—dark grey circles with unbroken line);

ovariectomised rats given sclerostin antibody once a week for the first period and then vehicle in the second time periods ("OVX+SAB→Veh—light grey squares, unbroken line);

ovariectomised rats given sclerostin antibody once a week for the first period and then osteoprotegerin in the second period ("OVX+SAB→OPG—black diamonds, unbroken line); and ovariectomised rats given sclerostin antibody once a week for the first period and then in the second period sclerostin antibody once every four weeks in the second period ("OVX+SAB→Qwk—dark grey triangles, unbroken line).

Hence, overall the changeover to less frequent dosing, allows for a high rate of bone formation before the switchover and then a more controlled slow increase in bone density. The switchover therefore allows a further opportunity to control bone formation in a precise manner, whilst using less antibody overall.

SEQUENCE LISTING (809 sequences)

SEQ ID NO: 1 - protein, 190 aa, Homo sapiens
QGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 2 - protein, 14 aa, Homo sapiens
DVSEYSCRELHFTR

SEQ ID NO: 3 - protein, 16 aa, Homo sapiens
SAKPVTELVCSGQCGP

SEQ ID NO: 4 - protein, 17 aa, Homo sapiens
WWRPSGPDFRCIPDRYR

SEQ ID NO: 5 - protein, 12 aa, Homo sapiens
LVASCKCKRLTR

SEQ ID NO: 6 - protein, 26 aa, Homo sapiens
CGPARLLPNAIGRGKWWRPSGPDFRC

SEQ ID NO: 7 - protein, 214 aa, Mus musculus
DVQMIQSPSSLSASLGDIVTMTCQASQGTSINLNWFQQKPGKAPKLLIYGSSNLEDGVPSRFSGSRYGTDFTLTISSLEDEDLATYFCLQHSYLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 8 - DNA, 645 bp, Mus musculus
gatgtccagatgattcagtctccatcctccctgtctgcatctttgggagacatagtcaccatgacttgccaggcaagtcagggcactagcattaatttaaactggtttcagcaaaaaccagggaaggctcctaagctcctgatctatggttcaagcaacttggaagatggggtcccatcaaggttcagtggcagtagatatgggacagatttcactctcaccatcagcagcctggaggatgaagatctggcaacttatttctgtctacaacatagttatctcccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 9 - protein, 236 aa, Mus musculus
MNTRAPAEFLGFLLLWFLGARCDVQMIQSPSSLSASLGDIVTMTCQASQGTSINLNWFQQKPGKAPKLLIYGSSNLEDGVPSRFSGSRYGTDFTLTISSLEDEDLATYFCLQHSYLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 10 - DNA, 711 bp, Mus musculus
atgaacacgagggcccctgctgagttccttgggttcctgttgctctggtttttaggtgccagatgtgatgtccagatgattcagtctccatcctccctgtctgcatctttgggagacatagtcaccatgacttgccaggcaagtcagggcactagcattaatttaaactggtttcagcaaaaaccagggaaggctcctaagctcctgatctatggttcaagcaacttggaagatggggtcccatcaaggttcagtggcagtagatatgggacagatttcactctcaccatcagcagcctggaggatgaagatctggcaacttatttctgtctacaacatagttatctcccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 11 - protein, 443 aa, Mus musculus
EVQLQQSGPELVTPGASVKISCKASGYTFTDHYMSWVKQSHGKSLEWIGDINPYSGETTYNQKFKGTATLTVDKSSSIAYMEIRGLTSEDSAVYYCARDDYDASPFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSPAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 12 - DNA, 1332 bp, Mus musculus
gaggtccagctgcaacagtctggacctgaactggtgacgcctggggcttcagtgaagatatcttgtaaggcttctggatacacattcactgaccactacatgagctgggtgaagcagagtcatggaaaaagccttgagtggattggagatattaatccctattctggtgaaactacctacaaccagaagttcaagggcacggccacattgactgtagacaagtcttccagtatagcctacatggagatccgcggcctgacatctgaggactctgcagtctattactgtgcaagagatgattacgacgcctctccgtttgcttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtccagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 13 - protein, 462 aa, Mus musculus
MRCRWIFLFLLSGTAGVLSEVQLQQSGPELVTPGASVKISCKASGYTFTDHYMSWVKQSHGKSLEWIGDINPYSGETTYNQKFKGTATLTVDKSSSIAYMEIRGLTSEDSAVYYCARDDYDASPFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSPAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 14 - DNA, 1389 bp, Mus musculus
atgagatgcaggtggatctttctctttctcctgtcaggaactgcaggtgtcctctctgaggtccagctgcaacagtctggacctgaactggtgacgcctggggcttcagtgaagatatcttgtaaggcttctggatacacattcactgaccactacatgagctgggtgaagcagagtcatggaaaaagccttgagtggattggagatattaatccctattctggtgaaactacctacaaccagaagttcaagggcacggccacattgactgtagacaagtcttccagtatagcctacatggagatccgcggcctgacatctgaggactctgcagtctattactgtgcaagagatgattacgacgcctctccgtttgcttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtccagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 15 - protein, 218 aa, Mus musculus
DIVLTQSPASLTVSLGLRATISCKASQSVDYDGDSYMNWYQQKPGQPPKLLIYAASNLESGIPARFSGNGSGTDFTLNIHPVEEEDAVTYYCQQSNEDPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 16 - DNA, 657 bp, Mus musculus
gacattgtgctgacccaatctccagcttctttgactgtgtctctaggcctgagggccaccatctcctgcaaggccagccaaagtgttgattatgatggtgatagttatatgaactggtaccagcagaaaccaggacagccacccaaactcctcatctatgctgcatccaatctagaatctgggatcccagccaggtttagtggcaatgggtctgggacagacttcaccctcaacatccatcctgtggaggaggaggatgctgtaacctattactgtcaacaaagtaatgaggatccgtggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 17 - protein, 238 aa, Mus musculus
METDTILLWVLLLWVPGSTGDIVLTQSPASLTVSLGLRATISCKASQSVDYDGDSYMNWYQQKPGQPPKLLIYAASNLESGIPARFSGNGSGTDFTLNIHPVEEEDAVTYYCQQSNEDPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 18 - DNA, 717 bp, Mus musculus
atggagacagacacaatcctgctatgggtgctgctgctctgggttccaggctccactggtgacattgtgctgacccaatctccagcttctttgactgtgtctctaggcctgagggccaccatctcctgcaaggccagccaaagtgttgattatgatggtgatagttatatgaactggtaccagcagaaaccaggacagccacccaaactcctcatctatgctgcatccaatctagaatctgggatcccagccaggtttagtggcaatgggtctgggacagacttcaccctcaacatccatcctgtggaggaggaggatgctgtaacctattactgtcaacaaagtaatgaggatccgtggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 19 - protein, 449 aa, Mus musculus
EVQLQQSGPELVKPGTSVKMSCKASGYTFTDCYMNWVKQSHGKSLEWIGDINPFNGGTTYNQKFKGKATLTVDKSSSTAYMQLNSLTSDDSAVYYCARSHYYFDGRVPWDAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 20 - DNA, 1350 bp, Mus musculus
gaggtccagctgcaacaatctggacctgagctggtgaagcctgggacttcagtgaagatgtcctgtaaggcttctggatacacattcactgactgctacatgaactgggtgaagcagagccatgggaagagccttgaatggattggagatattaatcctttcaacggtggtactacctacaaccagaagttcaagggcaaggccacattgactgtagacaaatcctccagcacagcctacatgcagctcaacagcctgacatctgacgactctgcagtctattactgtgcaagatcccattattacttcgatggtagagtcccttgggatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 21 - protein, 468 aa, Mus musculus
MGWNWIFLFLLSGTAGVYSEVQLQQSGPELVKPGTSVKMSCKASGYTFTDCYMNWVKQSHGKSLEWIGDINPFNGGTTYNQKFKGKATLTVDKSSSTAYMQLNSLTSDDSAVYYCARSHYYFDGRVPWDAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 22 - DNA, 1407 bp, Mus musculus
atgggatggaactggatctttctcttcctcttgtcaggaactgcaggtgtctactctgaggtccagctgcaacaatctggacctgagctggtgaagcctgggacttcagtgaagatgtcctgtaaggcttctggatacacattcactgactgctacatgaactgggtgaagcagagccatgggaagagccttgaatggattggagatattaatcctttcaacggtggtactacctacaaccagaagttcaagggcaaggccacattgactgtagacaaatcctccagcacagcctacatgcagctcaacagcctgacatctgacgactctgcagtctattactgtgcaagatcccattattacttcgatggtagagtcccttgggatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 23 - protein, 217 aa, Artificial Sequence
  Synthetic Polypeptide
  MISC_FEATURE: Rabbit-mouse chimera
AQVLTQTPASVSAAVGGTVTINCQSSQSVYDNNWLAWFQQKPGQPPKLLIYDASDLASGVPSRFSGSGSGTQFTLTISGVQCADAATYYCQGAYNDVIYAFGGGTEVVVKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 24 - DNA, 654 bp, Artificial Sequence
  Synthetic Polynucleotide
  misc_feature: Rabbit-mouse chimera
gcgcaagtgctgacccagactccagcctccgtgtctgcagctgtgggaggcacagtcaccatcaattgccagtccagtcagagtgtttatgataacaactggttagcctggtttcagcagaaaccagggcagcctcccaagctcctgatttatgatgcatccgatctggcatctggggtcccatcgcggttcagtggcagtggatctgggacacagttcactctcaccatcagcggcgtgcagtgtgccgatgctgccacttactactgtcaaggcgcttataatgatgttatttatgctttcggcggagggaccgaggtggtggtcaaacgtacggatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 25 - protein, 239 aa, Artificial Sequence
  Synthetic Polypeptide
  MISC_FEATURE: Rabbit-mouse chimera
MDTRAPTQLLGLLLLWLPGATFAQVLTQTPASVSAAVGGTVTINCQSSQSVYDNNWLAWFQQKPGQPPKLLIYDASDLASGVPSRFSGSGSGTQFTLTISGVQCADAATYYCQGAYNDVIYAFGGGTEVVVKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 26 - DNA, 720 bp, Artificial Sequence
  Synthetic Polynucleotide
  misc_feature: Rabbit-mouse chimera
atggacacgagggcccccactcagctgctggggctcctgctgctctggctcccaggtgccacatttgcgcaagtgctgacccagactccagcctccgtgtctgcagctgtgggaggcacagtcaccatcaattgccagtccagtcagagtgtttatgataacaactggttagcctggtttcagcagaaaccagggcagcctcccaagctcctgatttatgatgcatccgatctggcatctggggtcccatcgcggttcagtggcagtggatctgggacacagttcactctcaccatcagcggcgtgcagtgtgccgatgctgccacttactactgtcaaggcgcttataatgatgttatttatgctttcggcggagggaccgaggtggtggtcaaacgtacggatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 27 - protein, 433 aa, Artificial Sequence
  Synthetic Polypeptide
  MISC_FEATURE: Humanized Antibody
QSLEESGGRLVTPGTPLTLTCTASGFSLSSYWMNWVRQAPGEGLEWIGTIDSGGRTDYASWAKGRFTISRTSTTMDLKMTSLTTGDTARYFCARNWNLWGQGTLVTVSSASTKGPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 28 - DNA, 1302 bp, Artificial Sequence
  Synthetic Polynucleotide
  misc_feature: Humanized Antibody
cagtcgctggaggagtccgggggtcgcctggtcacgcctgggacacccctgacactcacctgcacagcctctggattctccctcagtagttattggatgaactgggtccgccaggctccaggggaggggctggaatggatcggaaccattgattctggtggtaggacggactacgcgagctgggcaaaaggccgattcaccatctccagaacctcgactacgatggatctgaaaatgaccagtctgacgaccggggacacggcccgttatttctgtgccagaaattggaacttgtggggccaaggcaccctcgtcaccgtctcgagcgcttctacaaagggcccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 29 - protein, 452 aa, Artificial Sequence
  Synthetic Polypeptide
  MISC_FEATURE: Humanized Antibody
METGLRWLLLVAVLKGVHCQSLEESGGRLVTPGTPLTLTCTASGFSLSSYWMNWVRQAPGEGLEWIGTIDSGGRTDYASWAKGRFTISRTSTTMDLKMTSLTTGDTARYFCARNWNLWGQGTLVTVSSASTKGPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 30 - DNA, 1359 bp, Artificial Sequence
  Synthetic Polynucleotide
  misc_feature: Humanized Antibody
atggagactgggctgcgctggcttctcctggtcgctgtgctcaaaggtgtccactgtcagtcgctggaggagtccgggggtcgcctggtcacgcctgggacacccctgacactcacctgcacagcctctggattctccctcagtagttattggatgaactgggtccgccaggctccaggggaggggctggaatggatcggaaccattgattctggtggtaggacggactacgcgagctgggcaaaaggccgattcaccatctccagaacctcgactacgatggatctgaaaatgaccagtctgacgaccggggacacggcccgttatttctgtgccagaaattggaacttgtggggccaaggcaccctcgtcaccgtctcgagcgcttctacaaagggcccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 31 - protein, 213 aa, Mus musculus
QIVLTQSPTIVSASPGEKVTLICSASSSVSFVDWFQQKPGTSPKRWIYRTSNLGFGVPARFSGGGSGTSHSLTISRMEAEDAATYYCQQRSTYPPTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 32 - DNA, 642 bp, Mus musculus
caaattgttctcacccagtctccaacaatcgtgtctgcatctccaggggagaaggtcaccctaatctgcagtgccagttcaagtgtaagtttcgtggactggttccagcagaagccaggcacttctcccaaacgctggatttacagaacatccaacctgggttttggagtccctgctcgcttcagtggcggtggatctgggacctctcactctctcacaatcagccgaatggaggctgaagatgctgccacttattactgccagcaaaggagtacttacccacccacgttcggtgctgggaccaagctggaactgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 33 - protein, 235 aa, Mus musculus
MHFQVQIFSFLLISASVIVSRGQIVLTQSPTIVSASPGEKVTLICSASSSVSFVDWFQQKPGTSPKRWIYRTSNLGFGVPARFSGGGSGTSHSLTISRMEAEDAATYYCQQRSTYPPTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 34 - DNA, 708 bp, Mus musculus
atgcattttcaagtgcagattttcagcttcctgctaatcagtgcctcagtcatagtgtccagagggcaaattgttctcacccagtctccaacaatcgtgtctgcatctccaggggagaaggtcaccctaatctgcagtgccagttcaagtgtaagtttcgtggactggttccagcagaagccaggcacttctcccaaacgctggatttacagaacatccaacctgggttttggagtccctgctcgcttcagtggcggtggatctgggacctctcactctctcacaatcagccgaatggaggctgaagatgctgccacttattactgccagcaaaggagtacttacccacccacgttcggtgctgggaccaagctggaactgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 35 - protein, 449 aa, Mus musculus
QVTLKESGPGILQPSQTLSLTCSFSGFSLSTSGMGVGWIRHPSGKNLEWLAHIWWDDVKRYNPVLKSRLTISKDTSNSQVFLKIANVDTADTATYYCARIEDFDYDEEYYAMDYWGQGTSVIVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 36 - DNA, 1350 bp, Mus musculus
caggttactctgaaagagtctggccctgggatattgcagccctcccagaccctcagtctgacttgttctttctctgggttttcactgagcacttctggtatgggtgtaggctggattcgtcacccatcagggaagaatctggagtggctggcacacatttggtgggatgatgtcaagcgctataacccagtcctgaagagccgactgactatctccaaggatacctccaacagccaggtattcctcaagatcgccaatgtggacactgcagatactgccacatactactgtgctcgaatagaggactttgattacgacgaggagtattatgctatggactactggggtcaaggaacctcagtcatcgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 37 - protein, 468 aa, Mus musculus
MGRLTSSFLLLIVPAYVLSQVTLKESGPGILQPSQTLSLTCSFSGFSLSTSGMGVGWIRHPSGKNLEWLAHIWWDDVKRYNPVLKSRLTISKDTSNSQVFLKIANVDTADTATYYCARIEDFDYDEEYYAMDYWGQGTSVIVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 38 - DNA, 1407 bp, Mus musculus
atgggcaggcttacttcttcattcctgctactgattgtccctgcatatgtcctgtcccaggttactctgaaagagtctggccctgggatattgcagccctcccagaccctcagtctgacttgttctttctctgggttttcactgagcacttctggtatgggtgtaggctggattcgtcacccatcagggaagaatctggagtggctggcacacatttggtgggatgatgtcaagcgctataacccagtcctgaagagccgactgactatctccaaggatacctccaacagccaggtattcctcaagatcgccaatgtggacactgcagatactgccacatactactgtgctcgaatagaggactttgattacgacgaggagtattatgctatggactactggggtcaaggaacctcagtcatcgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 39 - protein, 5 aa, Mus musculus
DHYMS

SEQ ID NO: 40 - protein, 17 aa, Mus musculus
DINPYSGETTYNQKFKG

SEQ ID NO: 41 - protein, 10 aa, Mus musculus
DDYDASPFAY

SEQ ID NO: 42 - protein, 11 aa, Mus musculus
QASQGTSINLN

SEQ ID NO: 43 - protein, 7 aa, Mus musculus
GSSNLED

SEQ ID NO: 44 - protein, 9 aa, Mus musculus
LQHSYLPYT

SEQ ID NO: 45 - protein, 5 aa, Mus musculus
DCYMN

SEQ ID NO: 46 - protein, 17 aa, Mus musculus
DINPFNGGTTYNQKFKG

SEQ ID NO: 47 - protein, 16 aa, Mus musculus
SHYYFDGRVPWDAMDY

SEQ ID NO: 48 - protein, 15 aa, Mus musculus
KASQSVDYDGDSYMN

SEQ ID NO: 49 - protein, 7 aa, Mus musculus
AASNLES

SEQ ID NO: 50 - protein, 9 aa, Mus musculus
QQSNEDPWT

SEQ ID NO: 51 - protein, 5 aa, Artificial Sequence
  Synthetic Polypeptide
  MISC_FEATURE: Rabbit-mouse chimera
SYWMN

SEQ ID NO: 52 - protein, 16 aa, Artificial Sequence
  Synthetic Polypeptide
  MISC_FEATURE: Rabbit-mouse chimera
TIDSGGRTDYASWAKG

SEQ ID NO: 53 - protein, 4 aa, Artificial Sequence
  Synthetic Polypeptide
  MISC_FEATURE: Rabbit-Mouse Chimera
NWNL

SEQ ID NO: 54 - protein, 13 aa, Artificial Sequence
  Synthetic Polypeptide
  MISC_FEATURE: Rabbit-mouse chimera
QSSQSVYDNNWLA

SEQ ID NO: 55 - protein, 7 aa, Artificial Sequence
  Synthetic Polypeptide
  MISC_FEATURE: Rabbit-mouse chimera
DASDLAS

SEQ ID NO: 56 - protein, 10 aa, Artificial Sequence
  Synthetic Polypeptide
  MISC_FEATURE: Rabbit-mouse chimera
QGAYNDVIYA

SEQ ID NO: 57 - protein, 7 aa, Mus musculus
TSGMGVG

SEQ ID NO: 58 - protein, 16 aa, Mus musculus
HIWWDDVKRYNPVLKS

SEQ ID NO: 59 - protein, 14 aa, Mus musculus
EDFDYDEEYYAMDY

SEQ ID NO: 60 - protein, 10 aa, Mus musculus
SASSSVSFVD

SEQ ID NO: 61 - protein, 7 aa, Mus musculus
RTSNLGF

SEQ ID NO: 62 - protein, 9 aa, Mus musculus
QQRSTYPPT

SEQ ID NO: 63 - protein, 20 aa, Homo sapiens
CGPARLLPNAIGRGKWWRPS

SEQ ID NO: 64 - protein, 20 aa, Homo sapiens
GPARLLPNAIGRGKWWRPSG

SEQ ID NO: 65 - protein, 20 aa, Homo sapiens
PARLLPNAIGRGKWWRPSGP

SEQ ID NO: 66 - protein, 20 aa, Homo sapiens
ARLLPNAIGRGKWWRPSGPD

SEQ ID NO: 67 - protein, 20 aa, Homo sapiens
RLLPNAIGRGKWWRPSGPDF

SEQ ID NO: 68 - protein, 20 aa, Homo sapiens
LLPNAIGRGKWWRPSGPDFR

SEQ ID NO: 69 - protein, 20 aa, Homo sapiens
LPNAIGRGKWWRPSGPDFRC

SEQ ID NO: 70 - protein, 14 aa, Homo sapiens
SAKPVTELVCSGQC

SEQ ID NO: 71 - protein, 7 aa, Homo sapiens
LVASCKC

SEQ ID NO: 72 - protein, 8 aa, Homo sapiens
CRELHFTR

SEQ ID NO: 73 - protein, 7 aa, Homo sapiens
CIPDRYR

SEQ ID NO: 74 - DNA, 399 bp, Artificial Sequence
  Synthetic Polynucleotide
  misc_feature: Humanized Antibody Sequence
atggacacgagggcccccactcagctgctggggctcctgctgctctggctcccaggtgccacatttgctcaagttctgacccagagtccaagcagtctctccgccagcgtaggcgatcgtgtgactattacctgtcaatctagtcagagcgtgtatgataacaattggctggcgtggtaccagcaaaaaccgggcaaagccccgaagctgctcatctatgacgcgtccgatctggctagcggtgtgccaagccgtttcagtggcagtggcagcggtactgactttaccctcacaatttcgtctctccagccggaagatttcgccacttactattgtcaaggtgcttacaacgatgtgatttatgccttcggtcagggcactaaagtagaaatcaaacgt

SEQ ID NO: 75 - protein, 133 aa, Artificial Sequence
  Synthetic Polypeptide
  MISC_FEATURE: Humanized Antibody Sequence
MDTRAPTQLLGLLLLWLPGATFAQVLTQSPSSLSASVGDRVTITCQSSQSVYDNNWLAWYQQKPGKAPKLLIYDASDLASGVPSRFSGSGSGTDFTLTISSLQPEDFATYYCQGAYNDVIYAFGQGTKVEIKR

SEQ ID NO: 76 - DNA, 393 bp, Artificial Sequence
  Synthetic Polynucleotide
  misc_feature: Humanized Antibody Sequence
atggagactgggctgcgctggcttctcctggtcgctgtgctcaaaggtgtccactgtgaggtgcagctgttggagtctggaggcgggcttgtccagcctggagggagcctgcgtctctcttgtgcagcaagcggcttcagcttatcctcttactggatgaattgggtgcggcaggcacctgggaagggcctggagtgggtgggcaccattgattccggaggccgtacagactacgcgtcttgggcaaagggccgtttcaccatttcccgcgacaactccaaaaataccatgtacctccagatgaactctctccgcgcagaggacacagcacgttattactgtgcacgcaactggaatctgtggggtcaaggtactcttgtaacagtctcgagc

SEQ ID NO: 77 - protein, 131 aa, Artificial Sequence
  Synthetic Polypeptide
  MISC_FEATURE: Humanized Antibody Sequence
METGLRWLLLVAVLKGVHCEVQLLESGGGLVQPGGSLRLSCAASGFSLSSYWMNWVRQAPGKGLEWVGTIDSGGRTDYASWAKGRFTISRDNSKNTMYLQMNSLRAEDTARYYCARNWNLWGQGTLVTVSS

SEQ ID NO: 78 - protein, 11 aa, Mus musculus
RASQDISNYLN

SEQ ID NO: 79 - protein, 7 aa, Mus musculus
YTSRLLS

SEQ ID NO: 80 - protein, 9 aa, Mus musculus
QQGDTLPYT

SEQ ID NO: 81 - protein, 11 aa, Mus musculus
RASQDISNYLN

SEQ ID NO: 82 - protein, 24 aa, Rattus norvegicus
QGWQAFKNDATEIIPGLREYPEPP

SEQ ID NO: 83 - protein, 20 aa, Rattus norvegicus
TEIIPGLREYPEPPQELENN

SEQ ID NO: 84 - protein, 20 aa, Rattus norvegicus
PEPPQELENNQTMNRAENGG

SEQ ID NO: 85 - protein, 20 aa, Rattus norvegicus
ENGGRPPHHPYDTKDVSEYS

SEQ ID NO: 86 - protein, 14 aa, Rattus norvegicus
CRELHYTRFVTDGP

SEQ ID NO: 87 - protein, 25 aa, Rattus norvegicus
CRELHYTRFVTDGPSRSAKPVTELV

SEQ ID NO: 88 - protein, 23 aa, Rattus norvegicus
CRSAKPVTELVSSGQSGPRARLL

SEQ ID NO: 89 - protein, 25 aa, Rattus norvegicus
CGPARLLPNAIGRVKWWRPNGPDFR

SEQ ID NO: 90 - protein, 20 aa, Rattus norvegicus
RAQRVQLLCPGGAAPRSRKV

SEQ ID NO: 91 - protein, 16 aa, Rattus norvegicus
PGGAAPRSRKVRLVAS

SEQ ID NO: 92 - protein, 23 aa, Rattus norvegicus
KRLTRFHNQSELKDFGPETARPQ

SEQ ID NO: 93 - protein, 16 aa, Rattus norvegicus
IPDRYAQRVQLLSPGG

SEQ ID NO: 94 - protein, 24 aa, Rattus norvegicus
SELKDFGPETARPQKGRKPRPRAR

SEQ ID NO: 95 - protein, 23 aa, Rattus norvegicus
KGRKPRPRARGAKANQAELENAY

SEQ ID NO: 96 - protein, 18 aa, Rattus norvegicus
PNAIGRVKWWRPNGPDFR

SEQ ID NO: 97 - protein, 22 aa, Rattus norvegicus
KWWRPNGPDFRCIPDRYRAQRV

SEQ ID NO: 98 - protein, 213 aa, Rattus norvegicus
MQLSLAPCLACLLVHAAFVAVESQGWQAFKNDATEIIPGLREYPEPPQELENNQTMNRAENGGRPPHHPYDTKDVSEYSCRELHYTRFVTDGPCRSAKPVTELVCSGQCGPARLLPNAIGRVKWWRPNGPDFRCIPDRYRAQRVQLLCPGGAAPRSRKVRLVASCKCKRLTRFHNQSELKDFGPETARPQKGRKPRPRARGAKANQAELENAY

SEQ ID NO: 99 - protein, 7 aa, Mus musculus
YTSRLHS

SEQ ID NO: 100 - protein, 9 aa, Mus musculus
QQGDTLPYT

SEQ ID NO: 101 - protein, 11 aa, Mus musculus
RASQVITNYLY

SEQ ID NO: 102 - protein, 7 aa, Mus musculus
YTSRLHS

SEQ ID NO: 103 - protein, 9 aa, Mus musculus
QQGDTLPYT

SEQ ID NO: 104 - protein, 11 aa, Mus musculus
RASQDISNYLN

SEQ ID NO: 105 - protein, 7 aa, Mus musculus
YTSRLLS

SEQ ID NO: 106 - protein, 9 aa, Mus musculus
QQGDTLPYT

SEQ ID NO: 107 - protein, 11 aa, Mus musculus
RASQDISNYLN

SEQ ID NO: 108 - protein, 7 aa, Mus musculus
YTSRLFS

SEQ ID NO: 109 - protein, 9 aa, Mus musculus
QQGDTLPYT

SEQ ID NO: 110 - protein, 11 aa, Mus musculus
RASQDISNYLN

SEQ ID NO: 111 - protein, 7 aa, Mus musculus
YTSRLLS

SEQ ID NO: 112 - protein, 9 aa, Mus musculus
QQGDTLPYT

SEQ ID NO: 113 - protein, 11 aa, Mus musculus
RASQDISNYLN

SEQ ID NO: 114 - protein, 7 aa, Mus musculus
YTSTLQS

SEQ ID NO: 115 - protein, 9 aa, Mus musculus
QQGDTLPYT

SEQ ID NO: 116 - protein, 12 aa, Mus musculus
SVSSSISSSNLH

SEQ ID NO: 117 - protein, 213 aa, Mus musculus
QIVLSQSPAILSTSPGEKVTMTCRASSSVYYMHWYQQKPGSSPKPWIYATSNLASGVPVRFSGSGSGTSYSLTITRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 118 - DNA, 642 bp, Mus musculus
caaattgttctctcccagtctccagcaatcctgtctacatctccaggggagaaggtcacaatgacttgcagggccagctcaagtgtatattacatgcactggtaccagcagaagccaggatcctcccccaaaccctggatttatgccacatccaacctggcttctggagtccctgttcgcttcagtggcagtgggtctgggacctcttactctctcacaatcaccagagtggaggctgaagatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 119 - protein, 235 aa, Mus musculus
MDFQVQIFSFLLISASVIMSRGQIVLSQSPAILSTSPGEKVTMTCRASSSVYYMHWYQQKPGSSPKPWIYATSNLASGVPVRFSGSGSGTSYSLTITRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 120 - DNA, 708 bp, Mus musculus
atggattttcaagtgcagattttcagcttcctgctaatcagtgcttcagtcattatgtccaggggacaaattgttctctcccagtctccagcaatcctgtctacatctccaggggagaaggtcacaatgacttgcagggccagctcaagtgtatattacatgcactggtaccagcagaagccaggatcctcccccaaaccctggatttatgccacatccaacctggcttctggagtccctgttcgcttcagtggcagtgggtctgggacctcttactctctcacaatcaccagagtggaggctgaagatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 121 - protein, 445 aa, Mus musculus
EVQVQQSGPELVKPGASVKLSCTASGFNIKDYFIHWVKQRPEQGLEWIGRLDPEDGESDYAPKFQDKAIMTADTSSNTAYLQLRSLTSEDTAIYYCEREDYDGTYTFFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 122 - DNA, 1338 bp, Mus musculus
gaggttcaggtgcagcagtctgggccagaacttgtgaagccaggggcctcagtcaagttgtcctgcacagcttctggcttcaacattaaagactactttatacactgggtgaagcagaggcctgaacagggcctggagtggattggaaggcttgatcctgaggatggtgaaagtgattatgccccgaagttccaggacaaggccattatgacagcagacacatcatccaacacagcctatcttcagctcagaagcctgacatctgaggacactgccatctattattgtgagagagaggactacgatggtacctacaccttttttccttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 123 - protein, 464 aa, Mus musculus
MKCSWVIFFLMAVVTGVNSEVQVQQSGPELVKPGASVKLSCTASGFNIKDYFIHWVKQRPEQGLEWIGRLDPEDGESDYAPKFQDKAIMTADTSSNTAYLQLRSLTSEDTAIYYCEREDYDGTYTFFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 124 - DNA, 1395 bp, Mus musculus
atgaaatgcagctgggtcatcttcttcctgatggcagtggttacaggggtcaattcagaggttcaggtgcagcagtctgggccagaacttgtgaagccaggggcctcagtcaagttgtcctgcacagcttctggcttcaacattaaagactactttatacactgggtgaagcagaggcctgaacagggcctggagtggattggaaggcttgatcctgaggatggtgaaagtgattatgccccgaagttccaggacaaggccattatgacagcagacacatcatccaacacagcctatcttcagctcagaagcctgacatctgaggacactgccatctattattgtgagagagaggactacgatggtacctacaccttttttccttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 125 - protein, 215 aa, Mus musculus
EIVLTQSPALMAASPGEKVTITCSVSSTISSNHLHWFQQKSDTSPKPWIYGTSNLASGVPVRFSGSGSGTSYSLTISSMEAEDAATYYCQQWSSYPLTFGAGTKLELRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 126 - DNA, 648 bp, Mus musculus
gaaattgtgctcacccagtctccagcactcatggctgcatctccgggggagaaggtcaccatcacctgcagtgtcagttcaactataagttccaaccacttgcactggttccagcagaagtcagacacctcccccaaaccctggatttatggcacatccaacctggcttctggagtccctgttcgcttcagtggcagtggatctgggacctcttattctctcacaatcagcagcatggaggctgaggatgctgccacttattactgtcaacagtggagtagttacccactcacgttcggcgctgggaccaagctggagctgagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 127 - protein, 237 aa, Mus musculus
MDFHVQIFSFMLISVTVILSSGEIVLTQSPALMAASPGEKVTITCSVSSTISSNHLHWFQQKSDTSPKPWIYGTSNLASGVPVRFSGSGSGTSYSLTISSMEAEDAATYYCQQWSSYPLTFGAGTKLELRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 128 - DNA, 714 bp, Mus musculus
atggattttcatgtgcagattttcagcttcatgctaatcagtgtcacagtcattttgtccagtggagaaattgtgctcacccagtctccagcactcatggctgcatctccgggggagaaggtcaccatcacctgcagtgtcagttcaactataagttccaaccacttgcactggttccagcagaagtcagacacctcccccaaaccctggatttatggcacatccaacctggcttctggagtccctgttcgcttcagtggcagtggatctgggacctcttattctctcacaatcagcagcatggaggctgaggatgctgccacttattactgtcaacagtggagtagttacccactcacgttcggcgctgggaccaagctggagctgagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 129 - protein, 449 aa, Mus musculus
EVQLQQSGAELVRPGALVKLSCTASDFNIKDFYLHWMRQRPEQGLDWIGRIDPENGDTLYDPKFQDKATLTTDTSSNTAYLQLSGLTSETTAVYYCSREADYFHDGTSYWYFDVWGAGTTITVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 130 - DNA, 1350 bp, Mus musculus
gaggttcagctgcagcagtctggggctgaacttgtgaggccaggggccttagtcaagttgtcctgcacagcttctgacttcaacattaaagacttctatctacactggatgaggcagcggcctgaacagggcctggactggattggaaggattgatcctgagaatggtgatactttatatgacccgaagttccaggacaaggccactcttacaacagacacatcctccaacacagcctacctgcagctcagcggcctgacatctgagaccactgccgtctattactgttctagagaggcggattatttccacgatggtacctcctactggtacttcgatgtctggggcgcagggaccacaatcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 131 - protein, 468 aa, Mus musculus
MKCSWVIFFLMAVVTGVNSEVQLQQSGAELVRPGALVKLSCTASDFNIKDFYLHWMRQRPEQGLDWIGRIDPENGDTLYDPKFQDKATLTTDTSSNTAYLQLSGLTSETTAVYYCSREADYFHDGTSYWYFDVWGAGTTITVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 132 - DNA, 1407 bp, Mus musculus
atgaaatgcagctgggtcatcttcttcctgatggcagtggttacaggggtcaattcagaggttcagctgcagcagtctggggctgaacttgtgaggccaggggccttagtcaagttgtcctgcacagcttctgacttcaacattaaagacttctatctacactggatgaggcagcggcctgaacagggcctggactggattggaaggattgatcctgagaatggtgatactttatatgacccgaagttccaggacaaggccactcttacaacagacacatcctccaacacagcctacctgcagctcagcggcctgacatctgagaccactgccgtctattactgttctagagaggcggattatttccacgatggtacctcctactggtacttcgatgtctggggcgcagggaccacaatcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 133 - protein, 214 aa, Mus musculus
DIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 134 - DNA, 645 bp, Mus musculus
gatatccagatgacacagattacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 135 - protein, 234 aa, Mus musculus
MMSSAQFLGLLLLCFQGTRCDIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 136 - DNA, 705 bp, Mus musculus
atgatgtcctctgctcagttccttggtctcctgttgctctgttttcaaggtaccagatgtgatatccagatgacacagattacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 137 - protein, 447 aa, Mus musculus
EVQLQQSGPELMKPGASVKMSCKASGYTFTDYNMHWVKQNQGKTLEWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 138 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 139 - protein, 466 aa, Mus musculus
MGWSWTFLFLLSGTAGVLSEVQLQQSGPELMKPGASVKMSCKASGYTFTDYNMHWVKQNQGKTLEWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 140 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 141 - protein, 214 aa, Artificial Sequence
  Synthetic Polypeptide
  MISC_FEATURE: Humanized Antibody Sequence
DIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - DNA, 642 bp, Artificial Sequence
  Synthetic Polynucleotide
  misc_feature: Humanized Antibody Sequence
gacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 143 - protein, 236 aa, Artificial Sequence
  Synthetic Polypeptide
  MISC_FEATURE: Humanized Antibody Sequence
MDMRVPAQLLGLLLLWLRGARCDIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 144 - DNA, 708 bp, Artificial Sequence
  Synthetic Polynucleotide
  misc_feature: Humanized Antibody Sequence
atggacatgagggtccccgctcagctcctggggctcctgctactctggctccgaggtgccagatgtgacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 145 - protein, 449 aa, Artificial Sequence
  Synthetic Polypeptide
  MISC_FEATURE: Humanized Antibody Sequence
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 146 - DNA, 1347 bp, Artificial Sequence
  Synthetic Polynucleotide
  misc_feature: Humanized Antibody Sequence
gaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 147 - protein, 468 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 148 - DNA, 1404 bp, Mus musculus
atggactggacctggaggatcctcttcttggtggcagcagccacaggagcccactccgaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 149 - protein, 214 aa, Mus musculus
DIQMTQTTSSLSASLGDRVTISCRASQDISNYLNWFQQKPDGTLKLLIFYTSRLHSGVPSRFSGSGSGTDYSLTISNLEQEDIATYFCQQGDTLPYTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 150 - DNA, 645 bp, Mus musculus
gatatccagatgacacagactacatcctccctgtctgcctctctgggagacagagtcaccatcagttgcagggcaagtcaggacattagcaattatttaaactggtttcagcagaaaccagatggaactcttaaactcctgatcttctacacatcaagattacactcaggagttccatcaaggttcagtggcagtgggtctggaacagattattctctcaccattagcaacctggagcaagaagatattgccacttacttttgccaacagggtgatacgcttccgtacacgttcgggggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 151 - protein, 234 aa, Mus musculus
MMSSAQFLGLLLLCFQGTRCDIQMTQTTSSLSASLGDRVTISCRASQDISNYLNWFQQKPDGTLKLLIFYTSRLHSGVPSRFSGSGSGTDYSLTISNLEQEDIATYFCQQGDTLPYTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 152 - DNA, 705 bp, Mus musculus
atgatgtcctctgctcagttccttggtctcctgttgctctgttttcaaggtaccagatgtgatatccagatgacacagactacatcctccctgtctgcctctctgggagacagagtcaccatcagttgcagggcaagtcaggacattagcaattatttaaactggtttcagcagaaaccagatggaactcttaaactcctgatcttctacacatcaagattacactcaggagttccatcaaggttcagtggcagtgggtctggaacagattattctctcaccattagcaacctggagcaagaagatattgccacttacttttgccaacagggtgatacgcttccgtacacgttcgggggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 153 - protein, 447 aa, Mus musculus
EVQLQQSGPELMKPGASVKMSCKASGYTFTDYNMHWVKQNQGKSLEWIGEINPNSGGSGYNQKFKGKATLTVDKSSSTAYMELRSLTSEDSAVYYCARLVYDGSYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 154 - DNA, 1344 bp, Mus musculus
gaggtccagctgcaacagtctggacctgaactaatgaagcctggggcttcagtgaagatgtcctgcaaggcttctggatacacattcactgactacaacatgcactgggtgaaacagaaccaaggaaagagcctagagtggataggagaaattaatcctaacagtggtggtagtggctacaaccaaaagttcaaaggcaaggccacattgactgtagacaagtcttccagcacagcctacatggagctccgcagcctgacatctgaggactctgcagtctattactgtgcaagattggtctacgatggcagctacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 155 - protein, 466 aa, Mus musculus
MGWSWTFLFLLSGTAGVLSEVQLQQSGPELMKPGASVKMSCKASGYTFTDYNMHWVKQNQGKSLEWIGEINPNSGGSGYNQKFKGKATLTVDKSSSTAYMELRSLTSEDSAVYYCARLVYDGSYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 156 - DNA, 1401 bp, Mus musculus
atgggatggagctggacctttctcttcctcctgtcaggaactgcaggtgtcctctctgaggtccagctgcaacagtctggacctgaactaatgaagcctggggcttcagtgaagatgtcctgcaaggcttctggatacacattcactgactacaacatgcactgggtgaaacagaaccaaggaaagagcctagagtggataggagaaattaatcctaacagtggtggtagtggctacaaccaaaagttcaaaggcaaggccacattgactgtagacaagtcttccagcacagcctacatggagctccgcagcctgacatctgaggactctgcagtctattactgtgcaagattggtctacgatggcagctacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 157 - protein, 214 aa, Mus musculus
DIQMTQTTSSLSASLGDRVTICCRASQVITNYLYWYQQKPDGTFKLLIYYTSRLHSGVPSRFSGSGSGTDYSLTISNLEQEDIATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 158 - DNA, 642 bp, Mus musculus
gatatccagatgacacagactacatcctccctgtctgcctctctgggagacagagtcaccatctgttgcagggcaagtcaggtcattaccaattatttatactggtatcagcagaaaccagatggaacttttaaactcctgatctactacacatcaagattacactcaggagtcccatcaaggttcagtggcagtgggtctggaacagattattctctcaccattagcaacctggaacaggaagatattgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 159 - protein, 234 aa, Mus musculus
MMSSAQFLGLLLLCFQGTRCDIQMTQTTSSLSASLGDRVTICCRASQVITNYLYWYQQKPDGTFKLLIYYTSRLHSGVPSRFSGSGSGTDYSLTISNLEQEDIATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 160 - DNA, 702 bp, Mus musculus
atgatgtcctctgctcagttccttggtctcctgttgctctgttttcaaggtaccagatgtgatatccagatgacacagactacatcctccctgtctgcctctctgggagacagagtcaccatctgttgcagggcaagtcaggtcattaccaattatttatactggtatcagcagaaaccagatggaacttttaaactcctgatctactacacatcaagattacactcaggagtcccatcaaggttcagtggcagtgggtctggaacagattattctctcaccattagcaacctggaacaggaagatattgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 161 - protein, 447 aa, Mus musculus
EVQLQQSGPELMKPGASVKMSCKASGYTFTDYNMHWMKQNQGKSLEWIGEINPNSGGAGYNQQFKGKATLTVDKSSRTAYMELRSLTSEDSAVYYCARLGYVGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 162 - DNA, 1341 bp, Mus musculus
gaggtccagctgcaacagtctggacctgaactaatgaagcctggggcttcagtgaagatgtcctgcaaggcttctggatacacattcactgactacaacatgcactggatgaagcagaaccaaggaaagagcctagaatggataggagaaattaatcctaacagtggtggtgctggctacaaccagcagttcaaaggcaaggccacattgactgtagacaagtcctccaggacagcctacatggagctccgcagcctgacatctgaggactctgcagtctattactgtgcaagattgggctacgttggtaattacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 163 - protein, 466 aa, Mus musculus
MGWSWTFLFLLSGTAGVLSEVQLQQSGPELMKPGASVKMSCKASGYTFTDYNMHWMKQNQGKSLEWIGEINPNSGGAGYNQQFKGKATLTVDKSSRTAYMELRSLTSEDSAVYYCARLGYVGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 164 - DNA, 1398 bp, Mus musculus
atgggatggagctggacctttctcttcctcctgtcaggaactgcaggtgtcctctctgaggtccagctgcaacagtctggacctgaactaatgaagcctggggcttcagtgaagatgtcctgcaaggcttctggatacacattcactgactacaacatgcactggatgaagcagaaccaaggaaagagcctagaatggataggagaaattaatcctaacagtggtggtgctggctacaaccagcagttcaaaggcaaggccacattgactgtagacaagtcctccaggacagcctacatggagctccgcagcctgacatctgaggactctgcagtctattactgtgcaagattgggctacgttggtaattacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 165 - protein, 214 aa, Mus musculus
DIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 166 - DNA, 645 bp, Mus musculus
gatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 167 - protein, 234 aa, Mus musculus
MMSSAQFLGLLLLCFQGTRCDIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 168 - DNA, 705 bp, Mus musculus
atgatgtcctctgctcagttccttggtctcctgttgctctgttttcaaggtaccagatgtgatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 169 - protein, 447 aa, Mus musculus
EVQLQQSGPELMKPGASVKMSCKASGYTFTDYNMHWVKQNQGKTLDWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 170 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagactggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 171 - protein, 466 aa, Mus musculus
MGWSWTFLFLLSGTAGVLSEVQLQQSGPELMKPGASVKMSCKASGYTFTDYNMHWVKQNQGKTLDWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 172 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagactggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 173 - protein, 214 aa, Mus musculus
DIQMTQITSSLSASLGDRVSISCRASQDISNYLNWYQQKPDGTFKLLIFYTSRLFSGVPSRFSGSGSGTDYSLTIYNLEQEDFATYFCQQGDTLPYTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 174 - DNA, 642 bp, Mus musculus
gatatccagatgacacagattacatcctccctgtctgcctctctgggagacagggtctccatcagttgcagggcaagtcaagacattagcaattatttaaattggtatcagcagaaaccagatggaacttttaaactccttatcttctacacatcaagattattttcaggagtcccatcaaggttcagtggcagtgggtctggaacagattattctctcaccatttacaacctggagcaagaagattttgccacttacttttgccaacagggagatacgcttccgtacactttcggaggggggaccaaggtggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 175 - protein, 234 aa, Mus musculus
MMSSAQFLGLLLLCFQGTRCDIQMTQITSSLSASLGDRVSISCRASQDISNYLNWYQQKPDGTFKLLIFYTSRLFSGVPSRFSGSGSGTDYSLTIYNLEQEDFATYFCQQGDTLPYTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 176 - DNA, 702 bp, Mus musculus
atgatgtcctctgctcagttccttggtctcctgttgctctgttttcaaggtaccagatgtgatatccagatgacacagattacatcctccctgtctgcctctctgggagacagggtctccatcagttgcagggcaagtcaagacattagcaattatttaaattggtatcagcagaaaccagatggaacttttaaactccttatcttctacacatcaagattattttcaggagtcccatcaaggttcagtggcagtgggtctggaacagattattctctcaccatttacaacctggagcaagaagattttgccacttacttttgccaacagggagatacgcttccgtacactttcggaggggggaccaaggtggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 177 - protein, 450 aa, Mus musculus
EVQLQQSGPELMKPGTSVKMSCKASGYTFTDYNMHWVKQTQGKTLEWIGEINPNSGGAGYNQKFKGKATLTVDKSSTTAYMELRSLTSEDSAVYYCAKLGYDDIYDDWYFDVWGAGTTVTVSSAKTTAPSVYPLAPVCGDTTGSSVTLGCLVKGYFPEPVTLTWNSGSLSSDVHTFPALLQSGLYTLSSSVTVTTWPSQTITCNVAHPASSTKVDKKIEPRGSPTHKPCPPCPAPNLLGGPSVFIFPPKIKDVLMISLSPMVTCVVVDVSEDDPDVHVSWFVNNVEVHTAQTQTHREDYNSTIRVVSALPIQHQDWMSGKEFKCKVNNKALPAPIERTISKPKGPVRAPQVYVLPPPEEEMTKKQVTLTCMITDFMPEDIYVEWTNNGQTELNYKNTEPVLDSDGSYFMYSKLRVEKKNWVERNSYSCSVVHEGLHNHHTTKSFSRTPGK

SEQ ID NO: 178 - DNA, 1350 bp, Mus musculus
gaggtccaactgcaacagtctggacctgaactaatgaagcctgggacttcagtgaagatgtcctgcaaggcttctggatatacattcactgactacaacatgcactgggtgaagcagacccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaaaattgggctacgatgatatctacgacgactggtatttcgatgtctggggcgcagggaccacggtcaccgtctcctcagccaaaacaacagccccatcggtctatccactggcccctgtgtgtggagatacaactggctcctcggtgactctaggatgcctggtcaagggttatttccctgagccagtgaccttgacctggaactctggatccctgtccagtgatgtgcacaccttcccagctctcctgcagtctggcctctacaccctcagcagctcagtgactgtaaccacctggcccagccagaccatcacctgcaatgtggcccacccggcaagcagcaccaaagtggacaagaaaattgagcccagagggtccccaacacataaaccctgtcctccatgcccagctcctaacctcttgggtggaccatccgtcttcatcttccctccaaagatcaaggatgtactcatgatctccctgagccccatggtcacgtgtgtggtggtggatgtgagcgaggatgacccagatgtccatgtcagctggttcgtgaacaacgtggaagtacacacagctcagacacaaacccatagagaggattacaacagtactatccgggtggtcagtgccctccccatccagcaccaggactggatgagtggcaaggagttcaaatgcaaggtcaacaacaaagccctcccagcgcccatcgagagaaccatctcaaaacccaaagggccagtaagagctccacaggtatatgtcttgcctccaccagaagaagagatgactaagaaacaggtcactctgacctgcatgatcacagacttcatgcctgaagacatttacgtggagtggaccaacaacgggcaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 179 - protein, 469 aa, Mus musculus
MGWSWTFLFLLSGTAGVLSEVQLQQSGPELMKPGTSVKMSCKASGYTFTDYNMHWVKQTQGKTLEWIGEINPNSGGAGYNQKFKGKATLTVDKSSTTAYMELRSLTSEDSAVYYCAKLGYDDIYDDWYFDVWGAGTTVTVSSAKTTAPSVYPLAPVCGDTTGSSVTLGCLVKGYFPEPVTLTWNSGSLSSDVHTFPALLQSGLYTLSSSVTVTTWPSQTITCNVAHPASSTKVDKKIEPRGSPTHKPCPPCPAPNLLGGPSVFIFPPKIKDVLMISLSPMVTCVVVDVSEDDPDVHVSWFVNNVEVHTAQTQTHREDYNSTIRVVSALPIQHQDWMSGKEFKCKVNNKALPAPIERTISKPKGPVRAPQVYVLPPPEEEMTKKQVTLTCMITDFMPEDIYVEWTNNGQTELNYKNTEPVLDSDGSYFMYSKLRVEKKNWVERNSYSCSVVHEGLHNHHTTKSFSRTPGK

SEQ ID NO: 180 - DNA, 1407 bp, Mus musculus
atgggatggagctggacctttctcttcctcctgtcaggaactgcaggtgtcctctctgaggtccaactgcaacagtctggacctgaactaatgaagcctgggacttcagtgaagatgtcctgcaaggcttctggatatacattcactgactacaacatgcactgggtgaagcagacccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaaaattgggctacgatgatatctacgacgactggtatttcgatgtctggggcgcagggaccacggtcaccgtctcctcagccaaaacaacagccccatcggtctatccactggcccctgtgtgtggagatacaactggctcctcggtgactctaggatgcctggtcaagggttatttccctgagccagtgaccttgacctggaactctggatccctgtccagtgatgtgcacaccttcccagctctcctgcagtctggcctctacaccctcagcagctcagtgactgtaaccacctggcccagccagaccatcacctgcaatgtggcccacccggcaagcagcaccaaagtggacaagaaaattgagcccagagggtccccaacacataaaccctgtcctccatgcccagctcctaacctcttgggtggaccatccgtcttcatcttccctccaaagatcaaggatgtactcatgatctccctgagccccatggtcacgtgtgtggtggtggatgtgagcgaggatgacccagatgtccatgtcagctggttcgtgaacaacgtggaagtacacacagctcagacacaaacccatagagaggattacaacagtactatccgggtggtcagtgccctccccatccagcaccaggactggatgagtggcaaggagttcaaatgcaaggtcaacaacaaagccctcccagcgcccatcgagagaaccatctcaaaacccaaagggccagtaagagctccacaggtatatgtcttgcctccaccagaagaagagatgactaagaaacaggtcactctgacctgcatgatcacagacttcatgcctgaagacatttacgtggagtggaccaacaacgggcaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 181 - protein, 214 aa, Mus musculus
DIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPLSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 182 - DNA, 645 bp, Mus musculus
gatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccactatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 183 - protein, 234 aa, Mus musculus
MMSSAQFLGLLLLCFQGTRCDIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPLSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 184 - DNA, 705 bp, Mus musculus
atgatgtcctctgctcagttccttggtctcctgttgctctgttttcaaggtaccagatgtgatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccactatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 185 - protein, 447 aa, Mus musculus; identical to SEQ ID NO: 137

SEQ ID NO: 186 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagaatggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 187 - protein, 466 aa, Mus musculus; identical to SEQ ID NO: 139

SEQ ID NO: 188 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagaatggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 189 - protein, 213 aa, Mus musculus
QIVLSQSPAFLSVSPGDKVTMTCRASSSISYIHWFQQKPGSSPRSWIYATSNLASGVPGRFSGSGSGTSYSLTISRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 190 - DNA, 642 bp, Mus musculus
caaattgttctctcccagtctccagcattcctgtctgtatctccaggggataaggtcacaatgacttgcagggccagctcaagtataagttacatacactggtttcagcagaagccaggatcctcccccagatcctggatttatgccacatccaacctggcttctggagtccctggtcgcttcagtggcagtgggtctgggacctcttactctctcacaatcagcagagtggaggctgaggatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 191 - protein, 235 aa, Mus musculus
MDFQVQIFSFLLISASVIMSRGQIVLSQSPAFLSVSPGDKVTMTCRASSSISYIHWFQQKPGSSPRSWIYATSNLASGVPGRFSGSGSGTSYSLTISRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 192 - DNA, 708 bp, Mus musculus
atggattttcaagtgcagattttcagcttcctgctaatcagtgcttcagtcataatgtccagaggacaaattgttctctcccagtctccagcattcctgtctgtatctccaggggataaggtcacaatgacttgcagggccagctcaagtataagttacatacactggtttcagcagaagccaggatcctcccccagatcctggatttatgccacatccaacctggcttctggagtccctggtcgcttcagtggcagtgggtctgggacctcttactctctcacaatcagcagagtggaggctgaggatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 193 - protein, 445 aa, Mus musculus
EVQLQQSGADLVQPGASVKVSCTASGFDIKDYYIHWMKQRPDQGLEWIGRVDPDNGETEFAPKFPGKATFTTDTSSNTAYLQLRGLTSEDTAIYYCGREDYDGTYTWFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 194 - DNA, 1338 bp, Mus musculus
gaagttcagctgcaacagtctggggcagaccttgtgcagccaggggcctcagtcaaggtgtcctgcacagcttctggcttcgacattaaggactactatatacactggatgaaacagaggcctgaccagggcctggagtggattggaagggttgatcctgacaatggtgagactgaatttgccccgaagttcccgggcaaggccacttttacaacagacacatcctccaacacagcctacctacaactcagaggcctgacatctgaggacactgccatctattactgtgggagagaagactacgatggtacctacacctggtttccttattggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 195 - protein, 464 aa, Mus musculus
MKCSWVIFFLMAVVTGVNSEVQLQQSGADLVQPGASVKVSCTASGFDIKDYYIHWMKQRPDQGLEWIGRVDPDNGETEFAPKFPGKATFTTDTSSNTAYLQLRGLTSEDTAIYYCGREDYDGTYTWFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 196 - DNA, 1395 bp, Mus musculus
atgaaatgcagctgggtcatcttcttcctgatggcagtggttacaggggtcaattcagaagttcagctgcaacagtctggggcagaccttgtgcagccaggggcctcagtcaaggtgtcctgcacagcttctggcttcgacattaaggactactatatacactggatgaaacagaggcctgaccagggcctggagtggattggaagggttgatcctgacaatggtgagactgaatttgccccgaagttcccgggcaaggccacttttacaacagacacatcctccaacacagcctacctacaactcagaggcctgacatctgaggacactgccatctattactgtgggagagaagactacgatggtacctacacctggtttccttattggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 197 - protein, 214 aa, Mus musculus
DLQMTQTTSSLSASLGDRVTISCRASQDISNYLNWYQQKPDGTVKLLIFYTSTLQSGVPSRFSGSGSGTNYSLTITNLEQDDAATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 198 - DNA, 645 bp, Mus musculus
gatctccagatgacacagactacttcctccctgtctgcctctctgggagacagagtcaccatcagttgcagggcaagtcaggacattagcaattatttaaactggtatcagcagaaaccagatggaactgttaagctcctgatcttctacacatcaacattacagtcaggagtcccatcgaggttcagtggcagtgggtctggaacaaattattctctcaccattaccaacctggagcaagatgatgctgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 199 - protein, 234 aa, Mus musculus
MMSSAQFLGLLLLCFQGSRCDLQMTQTTSSLSASLGDRVTISCRASQDISNYLNWYQQKPDGTVKLLIFYTSTLQSGVPSRFSGSGSGTNYSLTITNLEQDDAATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 200 - DNA, 705 bp, Mus musculus
atgatgtcctctgctcagttccttggtctcctgttgctctgttttcaaggttccagatgtgatctccagatgacacagactacttcctccctgtctgcctctctgggagacagagtcaccatcagttgcagggcaagtcaggacattagcaattatttaaactggtatcagcagaaaccagatggaactgttaagctcctgatcttctacacatcaacattacagtcaggagtcccatcgaggttcagtggcagtgggtctggaacaaattattctctcaccattaccaacctggagcaagatgatgctgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 201 - protein, 447 aa, Mus musculus
EVQLQQSGPELMKPGASVKMSCKASGYTFTDYNMHWMKQNQGKSLEWIGEINPNSGGSGYNQKFKGKATLTVDKSSSTAYMELRSLTSEDSAVYYCARLGYYGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 202 - DNA, 1344 bp, Mus musculus
gaggtccagttgcaacagtctggacctgaactaatgaagcctggggcttcagtgaagatgtcctgcaaggcttctggatacacattcactgactacaacatgcactggatgaagcagaaccaaggaaagagcctagagtggataggagagattaatcctaacagtggtggttctggttacaaccagaagttcaaaggcaaggccacattgactgtagacaagtcctccagcacagcctacatggagctccgcagcctgacatctgaggactctgcagtctattactgtgcaagattgggctactatggtaactacgaggactggtatttcgatgtctggggcgcagggaccacggtcaccgtctcctctgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 203 - protein, 466 aa, Mus musculus
MGWSWTFLFLLSGTSGVLSEVQLQQSGPELMKPGASVKMSCKASGYTFTDYNMHWMKQNQGKSLEWIGEINPNSGGSGYNQKFKGKATLTVDKSSSTAYMELRSLTSEDSAVYYCARLGYYGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 204 - DNA, 1401 bp, Mus musculus
atgggatggagctggacctttctcttcctcctgtcaggaacttcgggtgtcctctctgaggtccagttgcaacagtctggacctgaactaatgaagcctggggcttcagtgaagatgtcctgcaaggcttctggatacacattcactgactacaacatgcactggatgaagcagaaccaaggaaagagcctagagtggataggagagattaatcctaacagtggtggttctggttacaaccagaagttcaaaggcaaggccacattgactgtagacaagtcctccagcacagcctacatggagctccgcagcctgacatctgaggactctgcagtctattactgtgcaagattgggctactatggtaactacgaggactggtatttcgatgtctggggcgcagggaccacggtcaccgtctcctctgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 205 - protein, 215 aa, Mus musculus
QIVLTQSPAIMSASPGEKVTMTCRASSSVTSSYLNWYQQKPGSSPKLWIYSTSNLASGVPARFSGSGSGTSYSLTISSVEAEDAATYYCQQYDFFPSTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 206 - DNA, 645 bp, Mus musculus
cagattgttctcacccagtctccagcaatcatgtctgcatctccaggggagaaggtcaccatgacctgcagggccagctcaagtgtaacttccagttacttgaactggtaccagcagaagccaggatcttcccccaaactctggatttatagcacatccaacctggcttcaggagtcccagctcgcttcagtggcagtgggtctgggacctcttactctctcacaatcagcagtgtggaggctgaggatgctgccacttattactgccagcagtatgattttttcccatcgacgttcggtggaggcaccaagctggaaatcaagcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccatcgtcaagagcttcaacaggaatgagtgt

SEQ ID NO: 207 - protein, 237 aa, Mus musculus
MDSQVQIFSFLLISALVKMSRGQIVLTQSPAIMSASPGEKVTMTCRASSSVTSSYLNWYQQKPGSSPKLWIYSTSNLASGVPARFSGSGSGTSYSLTISSVEAEDAATYYCQQYDFFPSTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 208 - DNA, 711 bp, Mus musculus
atggattctcaagtgcagattttcagcttccttctaatcagtgccttagtcaaaatgtccagaggacagattgttctcacccagtctccagcaatcatgtctgcatctccaggggagaaggtcaccatgacctgcagggccagctcaagtgtaacttccagttacttgaactggtaccagcagaagccaggatcttcccccaaactctggatttatagcacatccaacctggcttcaggagtcccagctcgcttcagtggcagtgggtctgggacctcttactctctcacaatcagcagtgtggaggctgaggatgctgccacttattactgccagcagtatgattttttcccatcgacgttcggtggaggcaccaagctggaaatcaagcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccatcgtcaagagcttcaacaggaatgagtgt

SEQ ID NO: 209 - protein, 445 aa, Mus musculus
EVQLQQSGPELVKPGASVKMSCKASGYTFTDYYMNWVKQSHGESLEWIGDINPYNDDTTYNHKFKGKATLTVDKSSNTAYMQLNSLTSEDSAVYYCARETAVITTNAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 210 - DNA, 1335 bp, Mus musculus
gaggtccagctgcaacaatctggacctgagctggtgaagcctggggcttcagtgaagatgtcctgtaaggcttctggatacacattcactgactactacatgaactgggtgaagcagagccatggagagagccttgagtggattggagatattaatccttacaacgatgatactacctacaaccacaagttcaagggcaaggccacattgactgtagacaaatcctccaacacagcctacatgcagctcaacagcctgacatctgaggactctgcagtctattactgtgcaagagagacggccgttattactacgaatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 211 - protein, 464 aa, Mus musculus
MGWNWIFLFLLSGTAGVYSEVQLQQSGPELVKPGASVKMSCKASGYTFTDYYMNWVKQSHGESLEWIGDINPYNDDTTYNHKFKGKATLTVDKSSNTAYMQLNSLTSEDSAVYYCARETAVITTNAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 212 - DNA, 1392 bp, Mus musculus
atgggatggaactggatctttctcttcctcttgtcaggaactgcaggtgtctactctgaggtccagctgcaacaatctggacctgagctggtgaagcctggggcttcagtgaagatgtcctgtaaggcttctggatacacattcactgactactacatgaactgggtgaagcagagccatggagagagccttgagtggattggagatattaatccttacaacgatgatactacctacaaccacaagttcaagggcaaggccacattgactgtagacaaatcctccaacacagcctacatgcagctcaacagcctgacatctgaggactctgcagtctattactgtgcaagagagacggccgttattactacgaatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 213 - protein, 215 aa, Artificial Sequence
  Synthetic Polypeptide
  MISC_FEATURE: Humanized Antibody Sequence
DIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 214 - DNA, 645 bp, Artificial Sequence
  Synthetic Polynucleotide
  misc_feature: Humanized Antibody Sequence
gacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 215 - protein, 237 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - DNA, 711 bp, Artificial Sequence
  Synthetic Polynucleotide
  misc_feature: Humanized Antibody Sequence
atggacatgagggtccccgctcagctcctggggctcctgctactctggctcccaggtgccagatgtgacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 217 - protein, 447 aa, Artificial Sequence
  Synthetic Polypeptide
  MISC_FEATURE: Humanized Antibody Sequence
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 218 - DNA, 1341 bp, Artificial Sequence
  Synthetic Polynucleotide
  misc_feature: Humanized Antibody Sequence
gaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 219 - protein, 466 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 220 - DNA, 1398 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 221 - protein, 215 aa, Artificial Sequence
  Synthetic Polypeptide
  MISC_FEATURE: Humanized Antibody Sequence
DIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - DNA, 645 bp, Artificial Sequence
  Synthetic Polynucleotide
  misc_feature: Humanized Antibody Sequence
gacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 223 - protein, 237 aa, Artificial Sequence
  Synthetic Polypeptide
  MISC_FEATURE: Humanized Antibody Sequence
MDMRVPAQLLGLLLLWLRGARCDIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - DNA, 711 bp, Artificial Sequence
  Synthetic Polynucleotide
  misc_feature: Humanized Antibody Sequence
atggacatgagggtccccgctcagctcctggggctcctgctactctggctccgaggtgccagatgtgacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 225 - protein, 451 aa, Artificial Sequence
  Synthetic Polypeptide
  MISC_FEATURE: Humanized Antibody Sequence
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 226 - DNA, 1353 bp, Artificial Sequence
  Synthetic Polynucleotide
gaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 227 - protein, 470 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 228 - DNA, 1410 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 229 - protein, 213 aa, Artificial Sequence
  Synthetic Polypeptide
  MISC_FEATURE: Humanized Antibody Sequence
DIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 230 - DNA, 639 bp, Artificial Sequence
  Synthetic Polynucleotide
  misc_feature: Humanized Antibody Sequence
gacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 231 - protein, 235 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - DNA, 705 bp, Artificial Sequence
  Synthetic Polynucleotide
  misc_feature: Humanized Antibody Sequence
atggacatgagggtccccgctcagctcctggggctcctgctgctctggctcccaggtgccagatgtgacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 233 - protein, 447 aa, Artificial Sequence
  Synthetic Polypeptide
  MISC_FEATURE: Humanized Antibody Sequence
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 234 - DNA, 1341 bp, Artificial Sequence
  Synthetic Polynucleotide
  misc_feature: Humanized Antibody Sequence
gaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 235 - protein, 466 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 236 - DNA, 1398 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 237 - protein, 7 aa, Mus musculus
GTSNLAS

SEQ ID NO: 238 - protein, 8 aa, Mus musculus
QQWTTTYT

SEQ ID NO: 239 - protein, 11 aa, Mus musculus
RASQDISSYLN

SEQ ID NO: 240 - protein, 7 aa, Mus musculus
STSRLNS

SEQ ID NO: 241 - protein, 8 aa, Mus musculus
QQDIKHPT

SEQ ID NO: 242 - protein, 11 aa, Mus musculus
KASQDVFTAVA

SEQ ID NO: 243 - protein, 7 aa, Mus musculus
WASTRHT

SEQ ID NO: 244 - protein, 9 aa, Mus musculus
QQYSSYPLT

SEQ ID NO: 245 - protein, 5 aa, Mus musculus
DYNMH

SEQ ID NO: 246 - protein, 17 aa, Mus musculus
EINPNSGGAGYNQKFKG

SEQ ID NO: 247 - protein, 14 aa, Mus musculus
LGYDDIYDDWYFDV

SEQ ID NO: 248 - protein, 5 aa, Mus musculus
DYNMH

SEQ ID NO: 249 - protein, 17 aa, Mus musculus
EINPNSGGSGYNQKFKG

SEQ ID NO: 250 - protein, 14 aa, Mus musculus
LVYDGSYEDWYFDV

SEQ ID NO: 251 - protein, 5 aa, Mus musculus
DYNMH

SEQ ID NO: 252 - protein, 17 aa, Mus musculus
EINPNSGGAGYNQQFKG

SEQ ID NO: 253 - protein, 14 aa, Mus musculus
LGYVGNYEDWYFDV

SEQ ID NO: 254 - protein, 5 aa, Mus musculus
DYNMH

SEQ ID NO: 255 - protein, 17 aa, Mus musculus
EINPNSGGAGYNQKFKG

SEQ ID NO: 256 - protein, 14 aa, Mus musculus
LGYDDIYDDWYFDV

SEQ ID NO: 257 - protein, 5 aa, Mus musculus
DYNMH

SEQ ID NO: 258 - protein, 17 aa, Mus musculus
EINPNSGGAGYNQKFKG

SEQ ID NO: 259 - protein, 14 aa, Mus musculus
LGYDDIYDDWYFDV

SEQ ID NO: 260 - protein, 5 aa, Mus musculus
DYNMH

SEQ ID NO: 261 - protein, 17 aa, Mus musculus
EINPNSGGAGYNQKFKG

SEQ ID NO: 262 - protein, 14 aa, Mus musculus
LGYDDIYDDWYFDV

SEQ ID NO: 263 - protein, 5 aa, Mus musculus
DYNMH

SEQ ID NO: 264 - protein, 17 aa, Mus musculus
EINPNSGGSGYNQKFKG

SEQ ID NO: 265 - protein, 14 aa, Mus musculus
LGYYGNYEDWYFDV

SEQ ID NO: 266 - protein, 5 aa, Mus musculus
DYYIH

SEQ ID NO: 267 - protein, 17 aa, Mus musculus
RIDPDNGESTYVPKFQG

SEQ ID NO: 268 - protein, 13 aa, Mus musculus
EGLDYGDYYAVDY

SEQ ID NO: 269 - protein, 5 aa, Mus musculus
DYIMH

SEQ ID NO: 270 - protein, 17 aa, Mus musculus
YINPYNDDTEYNEKFKG

SEQ ID NO: 271 - protein, 11 aa, Mus musculus
SIYYYDAPFAY

SEQ ID NO: 272 - protein, 5 aa, Mus musculus
DYYMH

SEQ ID NO: 273 - protein, 17 aa, Mus musculus
RIDPENGDIIYDPKFQG

SEQ ID NO: 274 - protein, 10 aa, Mus musculus
DAGDPAWFTY

SEQ ID NO: 275 - protein, 10 aa, Mus musculus
RASSSVYYMH

SEQ ID NO: 276 - protein, 7 aa, Mus musculus
ATSNLAS

SEQ ID NO: 277 - protein, 9 aa, Mus musculus
QQWSSDPLT

SEQ ID NO: 278 - protein, 12 aa, Mus musculus
SVSSTISSNHLH

SEQ ID NO: 279 - protein, 7 aa, Mus musculus
GTSNLAS

SEQ ID NO: 280 - protein, 9 aa, Mus musculus
QQWSSYPLT

SEQ ID NO: 281 - protein, 10 aa, Mus musculus
RASSSISYIH

SEQ ID NO: 282 - protein, 7 aa, Mus musculus
ATSNLAS

SEQ ID NO: 283 - protein, 9 aa, Mus musculus
QQWSSDPLT

SEQ ID NO: 284 - protein, 12 aa, Mus musculus
RASSSVTSSYLN

SEQ ID NO: 285 - protein, 7 aa, Mus musculus
STSNLAS

SEQ ID NO: 286 - protein, 9 aa, Mus musculus
QQYDFFPST

SEQ ID NO: 287 - protein, 5 aa, Mus musculus
DYFIH

SEQ ID NO: 288 - protein, 17 aa, Mus musculus
RLDPEDGESDYAPKFQD

SEQ ID NO: 289 - protein, 12 aa, Mus musculus
EDYDGTYTFFPY

SEQ ID NO: 290 - protein, 5 aa, Mus musculus
DFYLH

SEQ ID NO: 291 - protein, 17 aa, Mus musculus
RIDPENGDTLYDPKFQD

SEQ ID NO: 292 - protein, 16 aa, Mus musculus
EADYFHDGTSYWYFDV

SEQ ID NO: 293 - protein, 5 aa, Mus musculus
DYYIH

SEQ ID NO: 294 - protein, 17 aa, Mus musculus
RVDPDNGETEFAPKFPG

SEQ ID NO: 295 - protein, 12 aa, Mus musculus
EDYDGTYTWFPY

SEQ ID NO: 296 - protein, 5 aa, Mus musculus
DYYMN

SEQ ID NO: 297 - protein, 17 aa, Mus musculus
DINPYNDDTTYNHKFKG

SEQ ID NO: 298 - protein, 11 aa, Mus musculus
ETAVITTNAMD

SEQ ID NO: 299 - protein, 130 aa, Mus musculus
MDFQVQIFSFMLISVTVILSSGEIVLTQSPALMAASPGEKVTITCSVSSSISSSNLHWSQQKSGTSPKLWIYGTSNLASGVPVRFSGSGSGTSYSLTISSMEAEDAATYYCQQWTTTYTFGSGTKLELKR

SEQ ID NO: 300 - DNA, 390 bp, Mus musculus
atggattttcaggtgcagattttcagcttcatgctaatcagtgtcacagtcatattgtccagtggagaaattgtgctcacccagtctccagcactcatggctgcatctccaggggagaaggtcaccatcacctgcagtgtcagctcgagtataagttccagcaacttacactggtcccagcagaagtcaggaacctcccccaaactctggatttatggcacatccaaccttgcttctggagtccctgttcgcttcagtggcagtggatctgggacctcttattctctcacaatcagcagcatggaggctgaagatgctgccacttattactgtcaacagtggactactacgtatacgttcggatcggggaccaagctggagctgaaacgt

SEQ ID NO: 301 - protein, 141 aa, Mus musculus
MGWNWIIFFLMAVVTGVNSEVQLRQSGADLVKPGASVKLSCTASGFNIKDYYIHWVKQRPEQGLEWIGRIDPDNGESTYVPKFQGKATITADTSSNTAYLQLRSLTSEDTAIYYCGREGLDYGDYYAVDYWGQGTSVTVSS

SEQ ID NO: 302 - DNA, 423 bp, Mus musculus
atgggatggaactggatcatcttcttcctgatggcagtggttacaggggtcaattcagaggtgcagttgcggcagtctggggcagaccttgtgaagccaggggcctcagtcaagttgtcctgcacagcttctggcttcaacattaaagactactatatacactgggtgaagcagaggcctgaacagggcctggagtggattggaaggattgatcctgataatggtgaaagtacatatgtcccgaagttccagggcaaggccactataacagcagacacatcatccaacacagcctacctacaactcagaagcctgacatctgaggacactgccatctattattgtgggagagaggggctcgactatggtgactactatgctgtggactactggggtcaaggaacctcggtcacagtctcgagc

SEQ ID NO: 303 - protein, 130 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCSVSSSISSSNLHWYQQKPGKAPKLLIYGTSNLASGVPSRFSGSGSGTEFTLTISSLQPEDFATYYCQQWTTTYTFGQGTKLEIKR

SEQ ID NO: 304 - DNA, 390 bp, Artificial Sequence
  Synthetic Polynucleotide
  misc_feature: Humanized Antibody Sequence
atggatatgcgcgtgccggcgcagctgctgggcctgctgctgctgtggctgccgggcgcgcgctgcgatattcagctgacccagagcccgagctttctgagcgcgagcgtgggcgatcgcgtgaccattacctgcagcgtgagcagcagcattagcagcagcaacctgcattggtatcagcagaaaccgggcaaagcgccgaaactgctgatttatggcaccagcaacctggcgagcggcgtgccgagccgctttagcggcagcggcagcggcaccgaatttaccctgaccattagcagcctgcagccggaagattttgcgacctattattgccagcagtggaccaccacctatacctttggccagggcaccaaactggaaattaaacgt

SEQ ID NO: 305 - protein, 141 aa, Artificial Sequence
  Synthetic Polypeptide
  MISC_FEATURE: Humanized Antibody Sequence
MDWTWSILFLVAAPTGAHSEVQLVQSGAEVKKPGASVKVSCKASGFNIKDYYIHWVRQAPGQGLEWMGRIDPDNGESTYVPKFQGRVTMTTDTSTSTAYMELRSLRSDDTAVYYCAREGLDYGDYYAVDYWGQGTLVTVSS

SEQ ID NO: 306 - DNA, 423 bp, Artificial Sequence
  Synthetic Polynucleotide
  misc_feature: Humanized Antibody Sequence
atggattggacctggagcattctgtttctggtggcggcgccgaccggcgcgcatagcgaagtgcagctggtgcagagcggcgcggaagtgaaaaaaccgggcgcgagcgtgaaagtgagctgcaaagcgagcggctttaacattaaagattattatattcattgggtgcgccaggcgccgggccagggcctggaatggatgggccgcattgatccggataacggcgaaagcacctatgtgccgaaatttcagggccgcgtgaccatgaccaccgataccagcaccagcaccgcgtatatggaactgcgcagcctgcgcagcgatgataccgcggtgtattattgcgcgcgcgaaggcctggattatggcgattattatgcggtggattattggggccagggcaccctggtgaccgtctcgagc

SEQ ID NO: 307 - protein, 127 aa, Artificial Sequence
  Synthetic Polypeptide
  MISC_FEATURE: Humanized Antibody Sequence
MMSSAQFLGLLLLCFQGTRCDIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKR

SEQ ID NO: 308 - DNA, 381 bp, Mus musculus
atgatgtcctctgctcagttccttggtctcctgttgctctgttttcaaggtaccagatgtgatatccagatgacacagactacatcctccctgtctgcctctctgggagacagagtcaacatcagctgcagggcaagtcaggacattagcagttatttaaactggtatcagcagaaaccagatggaactgttaaactcctgatctactccacatcaagattaaactcaggagtcccatcaaggttcagtggcagtgggtctgggacagattattctctcactattagcaacctggcacaagaagatattgccacttacttttgccaacaggatattaagcatccgacgttcggtggaggcaccaagttggagctgaaacgt

SEQ ID NO: 309 - protein, 139 aa, Mus musculus
MEWIWIFLFLLSGTAGVHSEVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSS

SEQ ID NO: 310 - DNA, 417 bp, Mus musculus
atggaatggatctggatatttctcttcctcctgtcaggaactgcaggtgtccactctgaggtccagctgcagcagtctggacctgagctggtaaagcctggggcttcagtgaagatgtcctgcaaggcttctgggttcacattcactgactacattatgcactgggtgaagcagaagcctgggcagggccttgagtggattggatatattaatccttacaatgatgatactgaatacaatgagaagttcaaaggcaaggccacactgacttcagacaaatcctccagcacagcctacatggatctcagcagtctgacctctgagggctctgcggtctattactgtgcaagatcgatttattactacgatgccccgtttgcttactggggccaagggactctggtcacagtctcgagc

SEQ ID NO: 311 - protein, 127 aa, Artificial Sequence
  Synthetic Polypeptide
  MISC_FEATURE: Humanized Antibody Sequence
MMSSAQFLGLLLLCFQGTRCDIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKR

SEQ ID NO: 312 - DNA, 381 bp, Artificial Sequence
  Synthetic Polynucleotide
  misc_feature: Humanized Antibody Sequence
atgatgtcctctgctcagttccttggtctcctgttgctctgttttcaaggtaccagatgtgatatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgt

SEQ ID NO: 313 - protein, 139 aa, Artificial Sequence
  Synthetic Polypeptide
  MISC_FEATURE: Humanized Antibody Sequence
MEWIWIFLFLLSGTAGVHSEVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSS

SEQ ID NO: 314 - protein, 107 aa, Mus musculus
DIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKR

SEQ ID NO: 315 - protein, 128 aa, Mus musculus
MKSQTQVFVYMLLWLSGVEGDIVMTQSHKFMSTSVGDRVTITCKASQDVFTAVAWYQQKPGQSPKLLIYWASTRHTGVPDRFTGSGSGTDFTLTISNVQSEDLADYFCQQYSSYPLTFGAGTKLELKR

SEQ ID NO: 316 - DNA, 381 bp, Mus musculus
atgaagtcacagacccaggtctttgtatacatgttgctgtggttgtctggtgttgaaggagacattgtgatgacccagtctcacaaattcatgtccacgtcagtaggagacagggtcaccatcacctgcaaggccagtcaggatgtctttactgctgtagcctggtatcaacagaaaccaggacaatctcctaaactactgatttactgggcatccacccggcacactggagtccctgatcgcttcacaggcagtggatctgggacagatttcactctcaccattagcaatgtgcagtctgaagacttggcagattatttctgtcaacaatatagcagctatcctctcacgttcggtgctgggaccaagttggagctgaaa

SEQ ID NO: 317 - protein, 138 aa, Mus musculus
MGWNWIIFFLMAVVTGVNSEVQLQQSGAELVRPGALVKLSCKASGFNIKDYYMHWVKQRPEQGLEWIGRIDPENGDIIYDPKFQGKASITTDTSSNTAYLQLSSLTSEDTAVYYCAYDAGDPAWFTYWGQGTLVTVSS

SEQ ID NO: 318 - DNA, 411 bp, Mus musculus
atgggatggaactggatcatcttcttcctgatggcagtggttacaggggtcaattcagaggttcagctgcagcagtctggggctgagcttgtgaggccaggggccttagtcaagttgtcctgcaaagcttctggcttcaatattaaagactactatatgcactgggtgaagcagaggcctgaacagggcctggagtggattggaaggattgatcctgagaatggtgatattatatatgacccgaagttccagggcaaggccagtataacaacagacacatcctccaacacagcctacctgcagctcagcagcctgacgtctgaggacactgccgtctattactgtgcttacgatgctggtgaccccgcctggtttacttactggggccaagggactctggtcaccgtctcg

SEQ ID NO: 319 - protein, 130 aa, Mus musculus
MDMRVPAQLLGLLLLWLRGARCDIQMTQSPSSLSASVGDRVTITCKASQDVFTAVAWYQQKPGKAPKLLIYWASTRHTGVPSRFSGSGSGTDFTLTISSLQPEDFATYYCQQYSSYPLTFGGGTKVEIKR

SEQ ID NO: 320 - DNA, 390 bp, Mus musculus
atggatatgcgcgtgccggcgcagctgctgggcctgctgctgctgtggctgcgcggcgcgcgctgcgatatccagatgacccagagcccgagcagcctgagcgcgagcgtgggcgatcgcgtgaccattacctgcaaagcgagccaggatgtgtttaccgcggtggcgtggtatcagcagaaaccgggcaaagcgccgaaactgctgatttattgggcgagcacccgccataccggcgtgccgagtcgctttagcggcagcggcagcggcaccgattttaccctgaccattagcagcctgcagccggaagattttgcgacctattattgccagcagtatagcagctatccgctgacctttggcggcggcaccaaagtggaaattaaacgt

SEQ ID NO: 321 - protein, 138 aa, Artificial Sequence
  Synthetic Polypeptide
  MISC_FEATURE: Humanized Antibody Sequence
MDWTWSILFLVAAPTGAHSEVQLVQSGAEVKKPGASVKVSCKASGFNIKDYYMHWVRQAPGQGLEWIGRIDPENGDIIYDPKFQGRVTMTTDTSTSTAYMELRSLRSDDTAVYYCAYDAGDPAWFTYWGQGTLVTVSS

SEQ ID NO: 322 - DNA, 414 bp, Artificial Sequence
  Synthetic Polynucleotide
  misc_feature: Humanized Antibody Sequence
atggattggacctggagcattctgtttctggtggcggcgccgaccggcgcgcatagcgaagtgcagctggtgcagagcggcgcggaagtgaaaaaaccgggcgcgagcgtgaaagtgagctgcaaagcgagcggctttaacattaaagattattatatgcattgggtgcgccaggcgccgggccagggcctggaatggatcggccgcattgatccggaaaacggcgatattatttatgatccgaaatttcagggccgcgtgaccatgaccaccgataccagcaccagcaccgcgtatatggaactgcgcagcctgcgcagcgatgataccgcggtgtattattgcgcgtatgatgcgggcgatccggcgtggtttacctattggggccagggcaccctggtgaccgtctcgagc

SEQ ID NO: 323 - protein, 106 aa, Mus musculus
TDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 324 - protein, 320 aa, Mus musculus
AKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSH

SEQ ID NO: 325 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 327 - protein, 120 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSS

SEQ ID NO: 328 - protein, 120 aa, Mus musculus; identical to SEQ ID NO: 327

SEQ ID NO: 329 - protein, 120 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSS

SEQ ID NO: 330 - protein, 226 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSSTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 331 - protein, 447 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 332 - protein, 107 aa, Mus musculus
DIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIK

SEQ ID NO: 333 - protein, 324 aa, Mus musculus
AKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 334 - protein, 213 aa, Mus musculus
DIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 335 - protein, 444 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 336 - protein, 108 aa, Mus musculus
DIQMTQSPSSLSASVGDRVTITCKASQDVFTAVAWYQQKPGKAPKLLIYWASTRHTGVPSRFSGSGSGTDFTLTISSLQPEDFATYYCQQYSSYPLTFGGGTKVEIKR

SEQ ID NO: 337 - DNA, 324 bp, Mus musculus
gatatccagatgacccagagcccgagcagcctgagcgcgagcgtgggcgatcgcgtgaccattacctgcaaagcgagccaggatgtgtttaccgcggtggcgtggtatcagcagaaaccgggcaaagcgccgaaactgctgatttattgggcgagcacccgccataccggcgtgccgagtcgctttagcggcagcggcagcggcaccgattttaccctgaccattagcagcctgcagccggaagattttgcgacctattattgccagcagtatagcagctatccgctgacctttggcggcggcaccaaagtggaaattaaacgt

SEQ ID NO: 338 - protein, 119 aa, Mus musculus
EVQLVQSGAEVKKPGASVKVSCKASGFNIKDYYMHWVRQAPGQGLEWIGRIDPENGDIIYDPKFQGRVTMTTDTSTSTAYMELRSLRSDDTAVYYCAYDAGDPAWFTYWGQGTLVTVSS

SEQ ID NO: 339 - DNA, 357 bp, Mus musculus
gaagtgcagctggtgcagagcggcgcggaagtgaaaaaaccgggcgcgagcgtgaaagtgagctgcaaagcgagcggctttaacattaaagattattatatgcattgggtgcgccaggcgccgggccagggcctggaatggatcggccgcattgatccggaaaacggcgatattatttatgatccgaaatttcagggccgcgtgaccatgaccaccgataccagcaccagcaccgcgtatatggaactgcgcagcctgcgcagcgatgataccgcggtgtattattgcgcgtatgatgcgggcgatccggcgtggtttacctattggggccagggcaccctggtgaccgtctcgagc

SEQ ID NO: 340 - DNA, 1395 bp, Mus musculus
atggactggacctggaggatcctcttcttggtggcagcagccacaggagcccactccgaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 341 - protein, 213 aa, Mus musculus
DIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - DNA, 639 bp, Mus musculus
gacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 343 - protein, 235 aa, Mus musculus
MDMRVPAQLLGLLLLWLRGARCDIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 344 - DNA, 705 bp, Mus musculus
atggacatgagggtgcccgctcagctcctggggctcctgctgctgtggctgagaggtgccagatgtgacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 345 - protein, 446 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 346 - DNA, 1338 bp, Mus musculus
gaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 347 - protein, 465 aa, Mus musculus
MDWTWRILFLVAAATGAHSEVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 348 - DNA, 1395 bp, Mus musculus; identical to SEQ ID NO: 340

SEQ ID NO: 349 - DNA, 417 bp, Mus musculus
atggaatggatctggatatttctcttcctcctgtcaggaactgcaggtgtccactctgaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcacagtctcgagc

SEQ ID NO: 350 - protein, 218 aa, Mus musculus
DIVLTQSPASLAVSLGQRATIACKASQSVDYDGTSYMNWYQQKPGQPPKLLIYAASNLESEIPARFSGTGSGTDFTLNIHPVEEEDITTYYCQQSNEDPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 351 - protein, 15 aa, Mus musculus
KASQSVDYDGTSYMN

SEQ ID NO: 352 - protein, 7 aa, Mus musculus
AASNLES

SEQ ID NO: 353 - protein, 9 aa, Mus musculus
QQSNEDPFT

SEQ ID NO: 354 - DNA, 657 bp, Mus musculus
gacattgtgttgacccagtctccagcttctttggctgtgtctctagggcagagggccaccatcgcctgcaaggccagccaaagtgttgattatgatggtactagttatatgaattggtaccaacagaaaccaggacagccacccaaactcctcatctatgctgcatccaatctagaatctgagatcccagccaggtttagtggcactgggtctgggacagacttcaccctcaacatccatcctgtggaggaggaggatatcacaacctattactgtcagcaaagtaatgaggatccgttcacgttcggaggggggaccaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 355 - protein, 238 aa, Mus musculus
METDTILLWVLLLWVPGSTGDIVLTQSPASLAVSLGQRATIACKASQSVDYDGTSYMNWYQQKPGQPPKLLIYAASNLESEIPARFSGTGSGTDFTLNIHPVEEEDITTYYCQQSNEDPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 356 - DNA, 717 bp, Mus musculus
atggagacagacacaatcctgctatgggtgctgctgctctgggttccaggctccactggtgacattgtgttgacccagtctccagcttctttggctgtgtctctagggcagagggccaccatcgcctgcaaggccagccaaagtgttgattatgatggtactagttatatgaattggtaccaacagaaaccaggacagccacccaaactcctcatctatgctgcatccaatctagaatctgagatcccagccaggtttagtggcactgggtctgggacagacttcaccctcaacatccatcctgtggaggaggaggatatcacaacctattactgtcagcaaagtaatgaggatccgttcacgttcggaggggggaccaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 357 - protein, 442 aa, Mus musculus
QVQLQQPGTELVRPGTSVKLSCKASGYIFTTYWMNWVKQRPGQGLEWIGMIHPSASEIRLDQKFKDKATLTLDKSSSTAYMHLSGPTSVDSAVYYCARSGEWGSMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 358 - protein, 5 aa, Mus musculus
TYWMN

SEQ ID NO: 359 - protein, 17 aa, Mus musculus
MIHPSASEIRLDQKFKD

SEQ ID NO: 360 - protein, 9 aa, Mus musculus
SGEWGSMDY

SEQ ID NO: 361 - DNA, 1329 bp, Mus musculus
caggtccaactacagcagcctgggactgagctggtgaggcctggaacttcagtgaagttgtcctgtaaggcttctggctacatcttcaccacctactggatgaactgggtgaaacagaggcctggacaaggccttgagtggattggcatgattcatccttccgcaagtgaaattaggttggatcagaaattcaaggacaaggccacattgactcttgacaaatcctccagcacagcctatatgcacctcagcggcccgacatctgtggattctgcggtctattactgtgcaagatcaggggaatgggggtctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 362 - protein, 461 aa, Mus musculus
MGWSSIILFLVATATGVHSQVQLQQPGTELVRPGTSVKLSCKASGYIFTTYWMNWVKQRPGQGLEWIGMIHPSASEIRLDQKFKDKATLTLDKSSSTAYMHLSGPTSVDSAVYYCARSGEWGSMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 363 - DNA, 1386 bp, Mus musculus
atgggatggagctctatcatcctcttcttggtagcaacagctacaggtgtccactcccaggtccaactacagcagcctgggactgagctggtgaggcctggaacttcagtgaagttgtcctgtaaggcttctggctacatcttcaccacctactggatgaactgggtgaaacagaggcctggacaaggccttgagtggattggcatgattcatccttccgcaagtgaaattaggttggatcagaaattcaaggacaaggccacattgactcttgacaaatcctccagcacagcctatatgcacctcagcggcccgacatctgtggattctgcggtctattactgtgcaagatcaggggaatgggggtctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 364 - protein, 106 aa, Mus musculus
DIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIK

SEQ ID NO: 365 - DNA, 318 bp, Mus musculus
gacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaa

SEQ ID NO: 366 - protein, 120 aa, Mus musculus; identical to SEQ ID NO: 329

SEQ ID NO: 367 - DNA, 360 bp, Mus musculus
gaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagt

SEQ ID NO: 368 - protein, 108 aa, Mus musculus; identical to SEQ ID NO: 336

SEQ ID NO: 369 - DNA, 324 bp, Mus musculus; identical to SEQ ID NO: 337

SEQ ID NO: 370 - protein, 119 aa, Mus musculus; identical to SEQ ID NO: 338

SEQ ID NO: 371 - DNA, 357 bp, Mus musculus; identical to SEQ ID NO: 339

SEQ ID NO: 372 - protein, 108 aa, Mus musculus
DIQLTQSPSFLSASVGDRVTITCSVSSSISSSNLHWYQQKPGKAPKLLIYGTSNLASGVPSRFSGSGSGTEFTLTISSLQPEDFATYYCQQWTTTYTFGQGTKLEIKR

SEQ ID NO: 373 - DNA, 324 bp, Mus musculus
gatattcagctgacccagagcccgagctttctgagcgcgagcgtgggcgatcgcgtgaccattacctgcagcgtgagcagcagcattagcagcagcaacctgcattggtatcagcagaaaccgggcaaagcgccgaaactgctgatttatggcaccagcaacctggcgagcggcgtgccgagccgctttagcggcagcggcagcggcaccgaatttaccctgaccattagcagcctgcagccggaagattttgcgacctattattgccagcagtggaccaccacctatacctttggccagggcaccaaactggaaattaaacgt

SEQ ID NO: 374 - protein, 122 aa, Mus musculus
EVQLVQSGAEVKKPGASVKVSCKASGFNIKDYYIHWVRQAPGQGLEWMGRIDPDNGESTYVPKFQGRVTMTTDTSTSTAYMELRSLRSDDTAVYYCAREGLDYGDYYAVDYWGQGTLVTVSS

SEQ ID NO: 375 - DNA, 366 bp, Mus musculus
gaagtgcagctggtgcagagcggcgcggaagtgaaaaaaccgggcgcgagcgtgaaagtgagctgcaaagcgagcggctttaacattaaagattattatattcattgggtgcgccaggcgccgggccagggcctggaatggatgggccgcattgatccggataacggcgaaagcacctatgtgccgaaatttcagggccgcgtgaccatgaccaccgataccagcaccagcaccgcgtatatggaactgcgcagcctgcgcagcgatgataccgcggtgtattattgcgcgcgcgaaggcctggattatggcgattattatgcggtggattattggggccagggcaccctggtgaccgtctcgagc

SEQ ID NO: 376 - protein, 107 aa, Mus musculus [sequence omitted]

SEQ ID NO: 377 - DNA, 321 bp, Mus musculus
gacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaa

SEQ ID NO: 378 - protein, 123 aa, Mus musculus [sequence omitted]

SEQ ID NO: 379 - DNA, 369 bp, Mus musculus
gaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagt

SEQ ID NO: 380 - protein, 108 aa, Mus musculus
DIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIK

SEQ ID NO: 381 - DNA, 324 bp, Mus musculus
gacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaag

SEQ ID NO: 382 - protein, 121 aa, Mus musculus
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSS

SEQ ID NO: 383 - DNA, 363 bp, Mus musculus
gaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagt

SEQ ID NO: 384 - protein, 108 aa, Mus musculus
DIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIK

SEQ ID NO: 385 - DNA, 324 bp, Mus musculus
gacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaa

SEQ ID NO: 386 - protein, 125 aa, Mus musculus
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSS

SEQ ID NO: 387 - DNA, 375 bp, Mus musculus
gaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagt

SEQ ID NO: 388 - protein, 106 aa, Mus musculus
DIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIK

SEQ ID NO: 389 - DNA, 318 bp, Mus musculus
gacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaa

SEQ ID NO: 390 - protein, 121 aa, Mus musculus
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSS

SEQ ID NO: 391 - DNA, 363 bp, Mus musculus
gaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagt

SEQ ID NO: 392 - protein, 448 aa, Artificial Sequence
  Synthetic Polypeptide
  MISC_FEATURE: Humanized Antibody Sequence
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 393 - protein, 446 aa, Artificial Sequence
  Synthetic Polypeptide
  MISC_FEATURE: Humanized Antibody Sequence
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 394 - protein, 450 aa, Artificial Sequence
  Synthetic Polypeptide
  MISC_FEATURE: Humanized Antibody Sequence
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 395 - protein, 446 aa, Artificial Sequence
  Synthetic Polypeptide
  MISC_FEATURE: Humanized Antibody Sequence
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 396 - protein, 445 aa, Artificial Sequence
  Synthetic Polypeptide
  MISC_FEATURE: Humanized Antibody Sequence
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 397 - protein, 213 aa, Homo sapiens
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 398 - protein, 444 aa, Artificial
  Miscellaneous construct
QVQLVQSGAEVKKPGSSVKVSCKASGYTFTDYFLNWVRQAPGQGLEWMGTIYPYHDGTTYSQKFKGRVTITADKSTSTAYMELSSLRSEDTAVYYCAREEEDGQFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 399 - protein, 444 aa, Artificial
  Miscellaneous construct
QVQLVQSGAEVKKPGASVKVSCKVSGFPIKDTFQHWVRQAPGKGLEWMGWSDPEIGDTEYASKFQGRVTMTEDTSTDTAYMELSSLRSEDTAVYYCATGDTTYKFDFWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 400 - protein, 450 aa, Artificial
  Miscellaneous construct
EVQLVQSGAEVKKPGESLKISCKGSDFEIKDYYIHWVRQMPGKGLEWMGQIDAEDGETEYAPRFQGQVTISADKSISTAYLQWSSLKASDTAMYYCAREGYYYDGRDYWYFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 401 - protein, 214 aa, Artificial
  Miscellaneous construct
DIQMTQSPSSLSASVGDRVTITCSASQGIQWYLNWYQQKPGKAPKLLIYYTSSLHSGVPSRFSGSGSGTDFTLTISSLQPEDFATYYCQQHSKLPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 402 - protein, 214 aa, Artificial
  Miscellaneous construct
DIQMTQSPSSLSASVGDRVTITCKASQDVHTAVAWYQQKPGKAPKLLIYWASTRWTGVPSRFSGSGSGTDFTLTISSLQPEDFATYYCQQYSDYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 403 - protein, 213 aa, Artificial
  Miscellaneous construct
EIVLTQSPATLSLSPGERATLSCSASSSVSYIHWYQQKPGQAPRLLIYSTSELASGIPARFSGSGSGTDFTLTISSLEPEDFAVYYCQQLSHLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - DNA, 1332 bp, Artificial
  Miscellaneous construct
caggtgcagctggtgcagtctggggctgaggtgaagaagcctgggtcctcagtgaaggtttcctgcaaggcatctggatacacattcactgactactttctgaactgggtgcgacaggcccctggacaagggcttgagtggatgggaactatttatccttaccatgatggtactacctactctcagaagttcaagggcagagtcaccattaccgcggacaaatccacgagcacagcctacatggagctgagcagcctgagatctgaggacacggccgtgtattactgtgcgagagaggaagaggatggtcagttcgactactggggccaaggaaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 405 - DNA, 1332 bp, Artificial
  Miscellaneous construct
caggttcagctggtgcagtctggggctgaggtgaagaagcctggggcctcagtgaaggtctcctgcaaggtttccggcttccccattaaggacacctttcagcactgggtgcgacaggctcctggaaaagggcttgagtggatgggatggagcgatcctgagatcggtgatactgaatatgcctcgaagttccagggcagagtcaccatgaccgaggacacatctacagacacagcctacatggagctgagcagcctgagatctgaggacacggccgtgtattactgtgcaacaggcgacaccacatacaagtttgacttctgggggcaagggaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 406 - DNA, 1350 bp, Artificial
  Miscellaneous construct
gaggtgcagctggtgcagtctggagcagaggtgaaaaagcccggggagtctctgaagatctcctgtaagggttctgacttcgagattaaagactactatatacattgggtgcgccagatgcccgggaaaggcctggagtggatggggcagattgatgctgaggatggtgaaactgaatatgccccgaggttccagggccaggtcaccatctcagccgacaagtccatcagcaccgcctacctgcagtggagcagcctgaaggcctcggacaccgccatgtattactgtgcgagagagggttattactacgatgggcgcgactactggtacttcgatgtctggggccaagggaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 407 - DNA, 642 bp, Artificial
  Miscellaneous construct
gacatccagatgacccagtctccatcctctctgtctgcatctgtaggagacagagtcaccatcacttgcagtgcaagtcagggcattcagtggtatttaaactggtatcagcagaaaccagggaaagcccctaagctcctgatctattacacatcaagtttacactcaggggtcccatcaaggttcagtggcagtggatctgggacagatttcactctcaccatcagcagtctgcaacctgaagattttgcaacttactactgtcagcagcatagtaaacttcctcggacgttcggcggagggaccaaggtggagatcaaacggactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 408 - DNA, 642 bp, Artificial
  Miscellaneous construct
gacatccagatgacccagtctccatcctccctgtctgcatctgtaggagacagagtcaccatcacttgcaaggccagtcaggatgtgcacactgctgtagcctggtatcagcagaaaccagggaaagcccctaagctcctgatctattgggcatccacccggtggactggagtcccatcaaggttcagtggcagtggatctgggacagatttcactctcaccatcagcagtctgcaacctgaagattttgcaacttactactgtcagcaatatagcgattatccgtggacgttcggcggagggaccaaggtggagatcaaacggactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 409 - DNA, 639 bp, Artificial
  Miscellaneous construct
gaaattgtgttgacacagtctccagccaccctgtctttgtctccaggggaaagagccaccctctcctgcagtgccagctcaagtgtaagttacatccactggtaccaacagaaacctggccaggctcccaggctcctcatctatagcacatccgagctggcttctggcatcccagccaggttcagtggcagtgggtctgggacagacttcactctcaccatcagcagcctagagcctgaagattttgcagtttattactgtcagcagcttagtcatctcccgctcacgttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 410 - protein, 118 aa, Artificial
  Miscellaneous construct
QVQLVQSGAEVKKPGSSVKVSCKASGYTFTDYFLNWVRQAPGQGLEWMGTIYPYHDGTTYSQKFKGRVTITADKSTSTAYMELSSLRSEDTAVYYCAREEEDGQFDYWGQGTTVTVSS

SEQ ID NO: 411 - protein, 118 aa, Artificial [sequence omitted]

SEQ ID NO: 412 - protein, 124 aa, Artificial
  Miscellaneous construct
EVQLVQSGAEVKKPGESLKISCKGSDFEIKDYYIHWVRQMPGKGLEWMGQIDAEDGETEYAPRFQGQVTISADKSISTAYLQWSSLKASDTAMYYCAREGYYYDGRDYWYFDVWGQGTTVTVSS

SEQ ID NO: 413 - protein, 107 aa, Artificial
  Miscellaneous construct
DIQMTQSPSSLSASVGDRVTITCSASQGIQWYLNWYQQKPGKAPKLLIYYTSSLHSGVPSRFSGSGSGTDFTLTISSLQPEDFATYYCQQHSKLPRTFGGGTKVEIK

SEQ ID NO: 414 - protein, 107 aa, Artificial [sequence omitted]

SEQ ID NO: 415 - protein, 106 aa, Artificial
  Miscellaneous construct
EIVLTQSPATLSLSPGERATLSCSASSSVSYIHWYQQKPGQAPRLLIYSTSELASGIPARFSGSGSGTDFTLTISSLEPEDFAVYYCQQLSHLPLTFGGGTKVEIK

SEQ ID NO: 416 - protein, 10 aa, Artificial
  Miscellaneous construct
GYTFTDYFLN

SEQ ID NO: 417 - protein, 17 aa, Artificial
  Miscellaneous construct
TIYPYHDGTTYSQKFKG

SEQ ID NO: 418 - protein, 9 aa, Artificial
  Miscellaneous construct
EEEDGQFDY

SEQ ID NO: 419 - protein, 11 aa, Artificial
  Miscellaneous construct
SASQGIQWYLN

SEQ ID NO: 420 - protein, 7 aa, Artificial
  Miscellaneous construct
YTSSLHS

SEQ ID NO: 421 - protein, 9 aa, Artificial
  Miscellaneous construct
QQHSKLPRT

SEQ ID NO: 422 - protein, 10 aa, Artificial
  Miscellaneous construct
GFPIKDTFQH

SEQ ID NO: 423 - protein, 17 aa, Artificial
  Miscellaneous construct
WSDPEIGDTEYASKFQG

SEQ ID NO: 424 - protein, 9 aa, Artificial
  Miscellaneous construct
GDTTYKFDF

SEQ ID NO: 425 - protein, 11 aa, Artificial
  Miscellaneous construct
KASQDVHTAVA

SEQ ID NO: 426 - protein, 7 aa, Artificial
  Miscellaneous construct
WASTRWT

SEQ ID NO: 427 - protein, 9 aa, Artificial
  Miscellaneous construct
QQYSDYPWT

SEQ ID NO: 428 - protein, 10 aa, Artificial
  Miscellaneous construct
DFEIKDYYIH

SEQ ID NO: 429 - protein, 17 aa, Artificial
  Miscellaneous construct
QIDAEDGETEYAPRFQG

SEQ ID NO: 430 - protein, 17 aa, Artificial
  Miscellaneous construct
QIDAEDGETEYAPRFQG

SEQ ID NO: 431 - protein, 17 aa, Artificial
  Miscellaneous construct
QIDAEDGETEYAPRFQG

SEQ ID NO: 432 - protein, 7 aa, Artificial
  Miscellaneous construct
STSELAS

SEQ ID NO: 433 - protein, 9 aa, Artificial
  Miscellaneous construct
QQLSHLPLT

SEQ ID NO: 434 - protein, 322 aa, Artificial
  Miscellaneous construct
GPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 435 - DNA, 970 bp, Artificial
  Miscellaneous construct
ggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccgctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggttga

SEQ ID NO: 436 - protein, 444 aa, Artificial
  Miscellaneous construct
EVQLQQSVAELVRPGASVKLSCTASGFNIKSTFMHWVKQRPDQGLEWIGWIDPENGDTEYASKFQGKATMTADTSSNTAYLQLSSLTSEDTAVYYCTTGESNYDFDFWGLGTTLTVSSAKTTPPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 437 - protein, 214 aa, Artificial
  Miscellaneous construct
DIVMTQSHKFMSTSVGDRVSITCKASQDVSTAVAWYQQKPGQSPKLLIYWASTRHTGVPDRFTGSGSGTDYTLTISDVQSEDLADYFCQQYSNYPWTFGGGTKLEIKRADAAPTVSIFPPSTEQLATGGASVVCLMNNFYPRDISVKWKIDGTERRDGVLDSVTDQDSKDSTYSMSSTLSLSKADYESHNLYTCEVVHKTSSSPVVKSFNRNEC

SEQ ID NO: 438 - protein, 450 aa, Artificial
  Miscellaneous construct
EVQLQQSGAEHVKPGASVKLSCTASDFNIKDYYIHWVKQRTAQGLEWIGRIDPEDGETEYAPRFQGKATIIADTSSNTAYLQLSSLTSEDTAVYYCAREGYYYDSRDYWYFDVWGTGTTVTVSSAKTTPPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 439 - protein, 213 aa, Artificial
  Miscellaneous construct
EIVLTQSPALMSASPGEKVTMTCSASSSVSYMHWFQQKPGTSPKLWIYSTSNLASGVPARFSGSGSGTSYSLTISSMEAEDAATYYCQQWSSNPLTFGAGTKLELKRADAAPTVSIFPPSTEQLATGGASVVCLMNNFYPRDISVKWKIDGTERRDGVLDSVTDQDSKDSTYSMSSTLSLSKADYESHNLYTCEVVHKTSSSPVVKSFNRNEC

SEQ ID NO: 440 - protein, 10 aa, Homo sapiens
GFTFSSYVMN

SEQ ID NO: 441 - protein, 10 aa, Homo sapiens
GFTFRSHWLS

SEQ ID NO: 442 - protein, 10 aa, Homo sapiens
GFTFSSYVMN

SEQ ID NO: 443 - protein, 10 aa, Homo sapiens
GFTFRSHWLS

SEQ ID NO: 444 - protein, 10 aa, Homo sapiens
GFTFRSHWLS

SEQ ID NO: 445 - protein, 10 aa, Homo sapiens
GFTFRSHWLS

SEQ ID NO: 446 - protein, 10 aa, Homo sapiens
GFTFRSHWLS

SEQ ID NO: 447 - protein, 10 aa, Homo sapiens
GFTFRSHWLS

SEQ ID NO: 448 - protein, 10 aa, Homo sapiens
GFTFRSHWLS

SEQ ID NO: 449 - protein, 10 aa, Homo sapiens
GFTFRSHWLS

SEQ ID NO: 450 - protein, 10 aa, Homo sapiens
GFTFRSHWLS

SEQ ID NO: 451 - protein, 20 aa, Homo sapiens
WVSFISGDSSNTYYADSVKG

SEQ ID NO: 452 - protein, 20 aa, Homo sapiens
WVSNINYDGSSTYYADSVKG

SEQ ID NO: 453 - protein, 20 aa, Homo sapiens
WVSFISGDSSNTYYADSVKG

SEQ ID NO: 454 - protein, 20 aa, Homo sapiens
WVSNINYDGSSTYYADSVKG

SEQ ID NO: 455 - protein, 19 aa, Homo sapiens
WVSVTGVHGDTYYADSVKG

SEQ ID NO: 456 - protein, 19 aa, Homo sapiens
WVSVIGNWGDTYYADSVKG

SEQ ID NO: 457 - protein, 19 aa, Homo sapiens
WVSVTTHQGYTYYADSVKG

SEQ ID NO: 458 - protein, 19 aa, Homo sapiens
WVSATNRYGYTYYADSVKG

SEQ ID NO: 459 - protein, 20 aa, Homo sapiens
WVSNINYDGSSTYYADSVKG

SEQ ID NO: 460 - protein, 19 aa, Homo sapiens
WVSVITPYGDTYYADSVKG

SEQ ID NO: 461 - protein, 19 aa, Homo sapiens
WVSVITPYGDTYYADSVKG

SEQ ID NO: 462 - protein, 15 aa, Homo sapiens
TFMHGHLGGGLSMDF

SEQ ID NO: 463 - protein, 8 aa, Homo sapiens
DTYLHFDY

SEQ ID NO: 464 - protein, 15 aa, Homo sapiens
TFMHGHLGGGLSMDF

SEQ ID NO: 465 - protein, 8 aa, Homo sapiens
DTYLHFDY

SEQ ID NO: 466 - protein, 8 aa, Homo sapiens
DTYLHFDY

SEQ ID NO: 467 - protein, 8 aa, Homo sapiens
DTYLHFDY

SEQ ID NO: 468 - protein, 8 aa, Homo sapiens
DTYLHFDY

SEQ ID NO: 469 - protein, 8 aa, Homo sapiens
DTYLHFDY

SEQ ID NO: 470 - protein, 8 aa, Homo sapiens
DTYLHFDY

SEQ ID NO: 471 - protein, 8 aa, Homo sapiens
DTYLHFDY

SEQ ID NO: 472 - protein, 8 aa, Homo sapiens
DTYLHFDY

SEQ ID NO: 473 - protein, 11 aa, Homo sapiens
SGDNIGSFYVH

SEQ ID NO: 474 - protein, 20 aa, Homo sapiens
WVSNINYDGSSTYYADSVKG

SEQ ID NO: 475 - protein, 20 aa, Homo sapiens
WVSNINYDGSSTYYADSVKG

SEQ ID NO: 476 - protein, 11 aa, Homo sapiens
SGDNIGSFYVH

SEQ ID NO: 477 - protein, 14 aa, Homo sapiens
TGTSSDVGDINDVS

SEQ ID NO: 478 - protein, 14 aa, Homo sapiens
TGTSSDVGDINDVS

SEQ ID NO: 479 - protein, 14 aa, Homo sapiens
TGTSSDVGDINDVS

SEQ ID NO: 480 - protein, 14 aa, Homo sapiens
TGTSSDVGDINDVS

SEQ ID NO: 481 - protein, 14 aa, Homo sapiens
TGTSSDVGDINDVS

SEQ ID NO: 482 - protein, 14 aa, Homo sapiens
TGTSSDVGDINDVS

SEQ ID NO: 483 - protein, 14 aa, Homo sapiens
TGTSSDVGDINDVS

SEQ ID NO: 484 - protein, 11 aa, Homo sapiens
LVIYDDNNRPS

SEQ ID NO: 485 - protein, 11 aa, Homo sapiens
LMIYDVNNRPS

SEQ ID NO: 486 - protein, 11 aa, Homo sapiens
LVIYDDNNRPS

SEQ ID NO: 487 - protein, 11 aa, Homo sapiens
LMIYDVNNRPS

SEQ ID NO: 488 - protein, 11 aa, Homo sapiens
LMIYDVNNRPS

SEQ ID NO: 489 - protein, 11 aa, Homo sapiens
LMIYDVNNRPS

SEQ ID NO: 490 - protein, 11 aa, Homo sapiens
LMIYDVNNRPS

SEQ ID NO: 491 - protein, 11 aa, Homo sapiens
LMIYDVNNRPS

SEQ ID NO: 492 - protein, 11 aa, Homo sapiens
LMIYDVNNRPS

SEQ ID NO: 493 - protein, 11 aa, Homo sapiens
LMIYDVNNRPS

SEQ ID NO: 494 - protein, 11 aa, Homo sapiens
LMIYDVNNRPS

SEQ ID NO: 495 - protein, 10 aa, Homo sapiens
GSWAGSSGSY

SEQ ID NO: 496 - protein, 10 aa, Homo sapiens
SSYGESLTSY

SEQ ID NO: 497 - protein, 10 aa, Homo sapiens
ASWTGVEPDY

SEQ ID NO: 498 - protein, 10 aa, Homo sapiens
QSYAGSYLSE

SEQ ID NO: 499 - protein, 10 aa, Homo sapiens
SSYGESLTSY

SEQ ID NO: 500 - protein, 10 aa, Homo sapiens
SSYGESLTSY

SEQ ID NO: 501 - protein, 10 aa, Homo sapiens
SSYGESLTSY

SEQ ID NO: 502 - protein, 10 aa, Homo sapiens
SSYGESLTSY

SEQ ID NO: 503 - protein, 10 aa, Homo sapiens
STYDGPGLSE

SEQ ID NO: 504 - protein, 10 aa, Homo sapiens
SSYGESLTSY

SEQ ID NO: 505 - protein, 10 aa, Homo sapiens
SSYGESLTSY

SEQ ID NO: 506 - protein, 124 aa, Homo sapiens
QVQLVESGGGLVQPGGSLRLSCAASGFTFSSYVMNWVRQAPGKGLEWVSFISGDSSNTYYADSVKGRFTISRDNSKNTLYLQMNSLRAEDTAVYYCARTFMHGHLGGGLSMDFWGQGTLVTVSS

SEQ ID NO: 507 - protein, 117 aa, Homo sapiens
QVQLVESGGGLVQPGGSLRLSCAASGFTFRSHWLSWVRQAPGKGLEWVSNINYDGSSTYYADSVKGRFTISRDNSKNTLYLQMNSLRAEDTAVYYCARDTYLHFDYWGQGTLVTVSS

SEQ ID NO: 508 - protein, 124 aa, Homo sapiens; identical to SEQ ID NO: 506

SEQ ID NO: 509 - protein, 117 aa, Homo sapiens; identical to SEQ ID NO: 507

SEQ ID NO: 510 - protein, 116 aa, Homo sapiens
QVQLVESGGGLVQPGGSLRLSCAASGFTFRSHWLSWVRQAPGKGLEWVSVTGVHGDTYYADSVKGRFTISRDNSKNTLYLQMNSLRAEDTAVYYCARDTYLHFDYWGQGTLVTVSS

SEQ ID NO: 511 - protein, 116 aa, Homo sapiens
QVQLVESGGGLVQPGGSLRLSCAASGFTFRSHWLSWVRQAPGKGLEWVSVIGNWGDTYYADSVKGRFTISRDNSKNTLYLQMNSLRAEDTAVYYCARDTYLHFDYWGQGTLVTVSS

SEQ ID NO: 512 - protein, 116 aa, Homo sapiens
QVQLVESGGGLVQPGGSLRLSCAASGFTFRSHWLSWVRQAPGKGLEWVSVTTHQGYTYYADSVKGRFTISRDNSKNTLYLQMNSLRAEDTAVYYCARDTYLHFDYWGQGTLVTVSS

SEQ ID NO: 513 - protein, 116 aa, Homo sapiens
QVQLVESGGGLVQPGGSLRLSCAASGFTFRSHWLSWVRQAPGKGLEWVSATNRYGYTYYADSVKGRFTISRDNSKNTLYLQMNSLRAEDTAVYYCARDTYLHFDYWGQGTLVTVSS

SEQ ID NO: 514 - protein, 117 aa, Homo sapiens; identical to SEQ ID NO: 507

SEQ ID NO: 515 - protein, 116 aa, Homo sapiens
QVQLVESGGGLVQPGGSLRLSCAASGFTFRSHWLSWVRQAPGKGLEWVSVITPYGDTYYADSVKGRFTISRDNSKNTLYLQMNSLRAEDTAVYYCARDTYLHFDYWGQGTLVTVSS

SEQ ID NO: 516 - protein, 116 aa, Homo sapiens; identical to SEQ ID NO: 515

SEQ ID NO: 517 - protein, 110 aa, Homo sapiens
DIELTQPPSVSVAPGQTARISCSGDNIGSFYVHWYQQKPGQAPVLVIYDDNNRPSGIPERFSGSNSGNTATLTISGTQAEDEADYYCGSWAGSSGSYVFGGRTKLTVLGQ

SEQ ID NO: 518 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCSSYGESLTSYVFGGGTKLTVLGQ

SEQ ID NO: 519 - protein, 110 aa, Homo sapiens
DIELTQPPSVSVAPGQTARISCSGDNIGSFYVHWYQQKPGQAPVLVIYDDNNRPSGIPERFSGSNSGNTATLTISGTQAEDEADYYCASWTGVEPDYVFGGGTKLTVLGQ

SEQ ID NO: 520 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCQSYAGSYLSEVFGGGTKLTVLGQ

SEQ ID NO: 521 - protein, 113 aa, Homo sapiens; identical to SEQ ID NO: 518

SEQ ID NO: 522 - protein, 113 aa, Homo sapiens; identical to SEQ ID NO: 518

SEQ ID NO: 523 - protein, 113 aa, Homo sapiens; identical to SEQ ID NO: 518

SEQ ID NO: 524 - protein, 113 aa, Homo sapiens; identical to SEQ ID NO: 518

SEQ ID NO: 525 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCSTYDGPGLSEVFGGGTKLTVLGQ

SEQ ID NO: 526 - protein, 113 aa, Homo sapiens; identical to SEQ ID NO: 518

SEQ ID NO: 527 - protein, 113 aa, Homo sapiens; identical to SEQ ID NO: 525

SEQ ID NO: 528 - DNA, 372 bp, Homo sapiens
caggtgcaattggtggaaagcggcggcggcctggtgcaaccgggcggcagcctgcgtctgagctgcgcggcctccggatttaccttttcttcttatgttatgaattgggtgcgccaagcccctgggaagggtctcgagtgggtgagctttatctctggtgattctagcaatacctattatgcggatagcgtgaaaggccgttttaccatttcacgtgataattcgaaaaacaccctgtatctgcaaatgaacagcctgcgtgcggaagatacggccgtgtattattgcgcgcgtacttttatgcatggtcatcttggtggtggtctttctatggatttttggggccaaggcaccctggtgacggttagctca

SEQ ID NO: 529 - DNA, 350 bp, Homo sapiens
caggtgcaattggtggaaagcggcggcggcctggtgcaaccgggcggcagcctgcgtctagctgcgcggcctccggatttacctttcgttctcattggctttcttgggtgcgccaagcccctgggaagggtctcgagtgggtgagcaatatcaattatgatggtagctctacctattatgcggatagcgtgaaaggccgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 530 - DNA, 372 bp, Homo sapiens; identical to SEQ ID NO: 528

SEQ ID NO: 531 - DNA, 351 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcaatatcaattatgatggtagctctacctattatgcggatagcgtgaaaggccgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 532 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttactggtgttcatggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 533 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttattggtaattggggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 534 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttactactcatcagggttatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 535 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgctactaatcgttatggttatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 536 - DNA, 351 bp, Homo sapiens; identical to SEQ ID NO: 531

SEQ ID NO: 537 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttattactccttatggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 538 - DNA, 348 bp, Homo sapiens; identical to SEQ ID NO: 537

SEQ ID NO: 539 - DNA, 330 bp, Homo sapiens
gatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcggttcttgggctggttcttctggttcttatgtgtttggcggccgcacgaagttaaccgttcttggccag

SEQ ID NO: 540 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgctcttcttatggtgagtctcttacttcttatgtgtttggcggcggcacgaagttaaccgttcttggccag

SEQ ID NO: 541 - DNA, 330 bp, Homo sapiens
gatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcgcttcttggactggtgttgagcctgattatgtgtttggcggcggcacgaagttaaccgttcttggccag

SEQ ID NO: 542 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgccagtcttatgctggttcttatctttctgaggtgtttggcggcggcacgaagttaaccgttcttggccag

SEQ ID NO: 543 - DNA, 339 bp, Homo sapiens; identical to SEQ ID NO: 540

SEQ ID NO: 544 - DNA, 339 bp, Homo sapiens; identical to SEQ ID NO: 540

SEQ ID NO: 545 - DNA, 339 bp, Homo sapiens; identical to SEQ ID NO: 540

SEQ ID NO: 546 - DNA, 339 bp, Homo sapiens; identical to SEQ ID NO: 540

SEQ ID NO: 547 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgctctacttatgatggtcctggtctttctgaggtgtttggcggcggcacgaagttaaccgttcttggccag

SEQ ID NO: 548 - DNA, 339 bp, Homo sapiens; identical to SEQ ID NO: 540

SEQ ID NO: 549 - DNA, 339 bp, Homo sapiens; identical to SEQ ID NO: 547

SEQ ID NO: 550 - protein, 469 aa, Homo sapiens
MAWVWTLPFLMAAAQSVQAQVQLVESGGGLVQPGGSLRLSCAASGFTFSSYVMNWVRQAPGKGLEWVSFISGDSSNTYYADSVKGRFTISRDNSKNTLYLQMNSLRAEDTAVYYCARTFMHGHLGGGLSMDFWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 551 - protein, 462 aa, Homo sapiens
MAWVWTLPFLMAAAQSVQAQVQLVESGGGLVQPGGSLRLSCAASGFTFRSHWLSWVRQAPGKGLEWVSNINYDGSSTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 552 - protein, 469 aa, Homo sapiens; identical to SEQ ID NO: 550

SEQ ID NO: 553 - protein, 462 aa, Homo sapiens; identical to SEQ ID NO: 551

SEQ ID NO: 554 - protein, 461 aa, Homo sapiens
MAWVWTLPFLMAAAQSVQAQVQLVESGGGLVQPGGSLRLSCAASGFTFRSHWLSWVRQAPGKGLEWVSVTGVHGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 555 - protein, 461 aa, Homo sapiens
MAWVWTLPFLMAAAQSVQAQVQLVESGGGLVQPGGSLRLSCAASGFTFRSHWLSWVRQAPGKGLEWVSVIGNWGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 556 - protein, 461 aa, Homo sapiens
MAWVWTLPFLMAAAQSVQAQVQLVESGGGLVQPGGSLRLSCAASGFTFRSHWLSWVRQAPGKGLEWVSVTTHQGYTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 557 - protein, 465 aa, Homo sapiens
MKHLWFFLLLVAAPRWVLSQVQLVESGGGLVQPGGSLRLSCAASGFTFRSHWLSWVRQAPGKGLEWVSATNRYGYTYYADSVKGRFTISRDNSKNTLYLQMNSLRAEDTAVYYCARDTYLHFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 558 - protein, 462 aa, Homo sapiens; identical to SEQ ID NO: 551

SEQ ID NO: 559 - protein, 461 aa, Homo sapiens
MAWVWTLPFLMAAAQSVQAQVQLVESGGGLVQPGGSLRLSCAASGFTFRSHWLSWVRQAPGKGLEWVSVITPYGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 560 - protein, 461 aa, Homo sapiens; identical to SEQ ID NO: 559

SEQ ID NO: 561 - protein, 130 aa, Homo sapiens
MSVLTQVLALLLLWLTGTRCDIELTQPPSVSVAPGQTARISCSGDNIGSFYVHWYQQKPGQAPVLVIYDDNNRPSGIPERFSGSNSGNTATLTISGTQAEDEADYYCGSWAGSSGSYVFGGRTKLTVLGQ

SEQ ID NO: 562 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCSSYGESLTSYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 563 - protein, 234 aa, Homo sapiens
MSVLTQVLALLLLWLTGTRCDIELTQPPSVSVAPGQTARISCSGDNIGSFYVHWYQQKPGQAPVLVIYDDNNRPSGIPERFSGSNSGNTATLTISGTQAEDEADYYCASWTGVEPDYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 564 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCQSYAGSYLSEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 565 - protein, 237 aa, Homo sapiens; identical to SEQ ID NO: 562

SEQ ID NO: 566 - protein, 237 aa, Homo sapiens; identical to SEQ ID NO: 562

SEQ ID NO: 567 - protein, 237 aa, Homo sapiens; identical to SEQ ID NO: 562

SEQ ID NO: 568 - protein, 237 aa, Homo sapiens; identical to SEQ ID NO: 562

SEQ ID NO: 569 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCSTYDGPGLSEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 570 - protein, 237 aa, Homo sapiens; identical to SEQ ID NO: 562

SEQ ID NO: 571 - protein, 237 aa, Homo sapiens; identical to SEQ ID NO: 569

SEQ ID NO: 572 - DNA, 1410 bp, Homo sapiens
atggcttgggtgtggaccttgccattcctgatggcagctgcccaaagcgtgcaggcccaggtgcagctggtcgagtctggcggcggactggtgcagcctggcggcagcctgagactgagctgcgccgccagcggcttcaccttcagcagctacgtgatgaactgggtgcggcaggcccctggcaagggcctggagtgggtgtccttcatcagcggcgacagcagcaacacctactacgccgacagcgtgaagggccggttcaccatcagccgggacaacagcaagaacaccctgtacctgcagatgaacagcctgcgggccgaggacaccgccgtgtactactgcgcccggaccttcatgcacggccacctgggcggaggactgagcatggatttctggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 573 - DNA, 1389 bp, Homo sapiens
atggcttgggtgtggaccttgccattcctgatggcagctgcccaaggtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccaacatcaactacgacggcagcagcacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 574 - DNA, 1410 bp, Homo sapiens; identical to SEQ ID NO: 572

SEQ ID NO: 575 - DNA, 1389 bp, Homo sapiens
atggcttgggtgtggaccttgccattcctgatggcagctgcccaaggtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccaacatcaactacgacggcagcagcacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagagacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 576 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgaccggcgtgcacggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 577 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgatcggcaactggggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 578 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgaccacccaccagggctacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 579 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgccaccaacagatacggctacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 580 - DNA, 1389 bp, Homo sapiens; identical to SEQ ID NO: 573

SEQ ID NO: 581 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgatcaccccctacggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 582 - DNA, 1386 bp, Homo sapiens; identical to SEQ ID NO: 581

SEQ ID NO: 583 - DNA, 393 bp, Homo sapiens
atgaaaaagacagctatcgcgattgcagtggcactggctggtttcgctaccgtagcgcaggccgatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcggttcttgggctggttcttctggttcttatgtgtttggcggccgcacgaagttaaccgttcttggccag

SEQ ID NO: 584 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgcagcagctacggcgagagcctgaccagctacgtgtttggcggcggaaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 585 - DNA, 705 bp, Homo sapiens
atgagtgtgctcactcaggtcctggcgttgctgctgctgtggcttacaggtacgcgttgcgacatcgagctgacccagccccccagcgtgagcgtggcccctggccagaccgcccggatcagctgcagcggcgacaacatcggcagcttctacgtgcactggtatcagcagaagcccggccaggcccccgtgctggtgatctacgacgacaacaaccggcccagcggcatccccgagcggttcagcggcagcaacagcggcaacaccgccaccctgaccatcagcggcacccaggccgaggacgaggccgactactactgcgccagctggaccggcgtggagcccgactacgtgtttggcggcggaacaaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 586 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgccagagctacgccggcagctacctgagcgaggtgttcggcggagggaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 587 - DNA, 714 bp, Homo sapiens; identical to SEQ ID NO: 584

SEQ ID NO: 588 - DNA, 714 bp, Homo sapiens; identical to SEQ ID NO: 584

SEQ ID NO: 589 - DNA, 714 bp, Homo sapiens; identical to SEQ ID NO: 584

SEQ ID NO: 590 - DNA, 714 bp, Homo sapiens; identical to SEQ ID NO: 584

SEQ ID NO: 591 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgcagcacctacgacggccctggcctgagcgaggtgttcggcggagggaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 592 - DNA, 714 bp, Homo sapiens; identical to SEQ ID NO: 591

SEQ ID NO: 593 - DNA, 714 bp, Homo sapiens; identical to SEQ ID NO: 591

SEQ ID NO: 594 - protein, 213 aa, Homo sapiens; identical to SEQ ID NO: 397

SEQ ID NO: 595 - protein, 14 aa, Homo sapiens
ARLLNAIGRGKWWR

SEQ ID NO: 596 - protein, 15 aa, Homo sapiens
RLVASCKCKRLTRFH

SEQ ID NO: 597 - protein, 13 aa, Homo sapiens
GGGSGGGGSGGGG

SEQ ID NO: 598 - protein, 19 aa, Homo sapiens
GGGGSGGGGSGGGGSGGGG

SEQ ID NO: 599 - DNA, 21 bp, Artificial
  siRNA
taaattatcataaagtcctaa

SEQ ID NO: 600 - DNA, 21 bp, Artificial
  siRNA
aggactttatgataatttatt

SEQ ID NO: 601 - DNA, 21 bp, Artificial
  siRNA
atagtggttaaataactccag

SEQ ID NO: 602 - DNA, 21 bp, Artificial
  siRNA
ggagttatttaaccactattt

SEQ ID NO: 603 - DNA, 21 bp, Artificial
  siRNA
taaattctcgtgatgtgccat

SEQ ID NO: 604 - DNA, 21 bp, Artificial
  siRNA
ggcacatcacgagaatttatt

SEQ ID NO: 605 - DNA, 21 bp, Artificial
  siRNA
tttcttatagcacagctggtt

SEQ ID NO: 606 - DNA, 21 bp, Artificial
  siRNA
ccagctgtgctataagaaatt

SEQ ID NO: 607 - DNA, 21 bp, Artificial
  siRNA
tagacctttccatccacgctg

SEQ ID NO: 608 - DNA, 21 bp, Artificial
  siRNA
gcgtggatggaaaggtctatt

SEQ ID NO: 609 - DNA, 29 bp, Artificial
  siRNA
atgcagctcccactggccctgtgtcttgt

SEQ ID NO: 610 - DNA, 30 bp, Artificial
  siRNA
aatcaggccgagctggagaacgcctactag

SEQ ID NO: 611 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
EVQLVESGGGLVQPGGSLRLSCAASGIPFSXXXXXWFRQAPGKQRDSVAXXXXXRFTISRDNAKNTVYLQMNSLKPEDTAVYRCYFXXXXXWGQGTQVTVSS

SEQ ID NO: 612 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
QVKLEESGGGLVQAGGSLRLSCVGSGRTFSXXXXXWFRLAPGKEREFVAXXXXXRFTISRDTASNRGYLHMNNLTPEDTAVYYCAAXXXXXWGQGTQVTVSS

SEQ ID NO: 613 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
AVQLVDSGGGLVQAGDSLKLSCALTGGAFTXXXXXWFRQTPGREREFVAXXXXXRFTISRDNAKNMVYLRMNSLIPEDAAVYSCAAXXXXXWGQGTLVTVSS

SEQ ID NO: 614 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
QVQLVESGGGLVEAGGSLRLSCTASESPFRXXXXXWFRQTSGQEREFVAXXXXXRFTISRDDAKNTVWLHGSTLKPEDTAVYYCAAXXXXXWGQGTQVTVSS

SEQ ID NO: 615 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
AVQLVESGGGLVQGGGSLRLACAASERIFDXXXXXWYRQGPGNERELVAXXXXXRFTISMDYTKQTVYLHMNSLRPEDTGLYYCKIXXXXXWGQGTQVTVSS

SEQ ID NO: 616 - protein, 102 aa, Artificial Sequence
  KERE-class Nanobody
  misc_feature (31)..(35): CDR
  misc_feature (50)..(54): CDR
  misc_feature (87)..(91): CDR
DVKFVESGGGLVQAGGSLRLSCVASGFNFDXXXXXWFRQAPGKEREEVAXXXXXRFTISSEKDKNSVYLQMNSLKPEDTALYICAGXXXXXWGRGTQVTVSS

SEQ ID NO: 617 - protein, 102 aa, Artificial Sequence
  KERE-class Nanobody
  misc_feature (31)..(35): CDR
  misc_feature (50)..(54): CDR
  misc_feature (87)..(91): CDR
QVRLAESGGGLVQSGGSLRLSCVASGSTYTXXXXXWYRQYPGKQRALVAXXXXXRFTIARDSTKDTFCLQMNNLKPEDTAVYYCYAXXXXXWGQGTQVTVSS

SEQ ID NO: 618 - protein, 102 aa, Artificial Sequence
  KERE-class Nanobody
  misc_feature (31)..(35): CDR
  misc_feature (50)..(54): CDR
  misc_feature (87)..(91): CDR
EVQLVESGGGLVQAGGSLRLSCAASGFTSDXXXXXWFRQAPGKPREGVSXXXXXRFTISTDNAKNTVHLLMNRVNAEDTALYYCAVXXXXXWGRGTRVTVSS

SEQ ID NO: 619 - protein, 102 aa, Artificial Sequence
  KERE-class Nanobody
  misc_feature (31)..(35): CDR
  misc_feature (50)..(54): CDR
  misc_feature (87)..(91): CDR
QVQLVESGGGLVQPGGSLRLSCQASGDISTXXXXXWYRQVPGKLREFVAXXXXXRFTISGDNAKRAIYLQMNNLKPDDTAVYYCNRXXXXXWGQGTQVTVSP

SEQ ID NO: 620 - protein, 102 aa, Artificial Sequence
  KERE-class Nanobody
  misc_feature (31)..(35): CDR
  misc_feature (50)..(54): CDR
  misc_feature (87)..(91): CDR
QVPVVESGGGLVQAGDSLRLFCAVPSFTSTXXXXXWFRQAPGKEREFVAXXXXXRFTISRNATKNTLTLRMDSLKPEDTAVYYCAAXXXXXWGQGTQVTVSS

SEQ ID NO: 621 - protein, 102 aa, Artificial Sequence
  KERE-class Nanobody
  misc_feature (31)..(35): CDR
  misc_feature (50)..(54): CDR
  misc_feature (87)..(91): CDR
EVQLVESGGGLVQAGDSLRLFCTVSGGTASXXXXXWFRQAPGEKREFVAXXXXXRFTIARENAGNMVYLQMNNLKPDDTALYTCAAXXXXXWGRGTQVTVSS

SEQ ID NO: 622 - protein, 102 aa, Artificial Sequence
  KERE-class Nanobody
  misc_feature (31)..(35): CDR
  misc_feature (50)..(54): CDR
  misc_feature (87)..(91): CDR
AVQLVESGGDSVQPGDSQTLSCAASGRTNSXXXXXWFRQAPGKERVFLAXXXXXRFTISRDSAKNMMYLQMNNLKPQDTAVYYCAAXXXXXWGQGTQVTVSS

SEQ ID NO: 623 - protein, 102 aa, Artificial Sequence
  KERE-class Nanobody
  misc_feature (31)..(35): CDR
  misc_feature (50)..(54): CDR
  misc_feature (87)..(91): CDR
AVQLVESGGGLVQAGGSLRLSCVVSGLTSSXXXXXWFRQTPWQERDFVAXXXXXRFTISRDNYKDTVLLEMNFLKPEDTAIYYCAAXXXXXWGQGTQVTVSS

SEQ ID NO: 624 - protein, 102 aa, Artificial Sequence
  KERE-class Nanobody
  misc_feature (31)..(35): CDR
  misc_feature (50)..(54): CDR
  misc_feature (87)..(91): CDR
AVQLVESGGGLVQAGASLRLSCATSTRTLDXXXXXWFRQAPGRDREFVAXXXXXRFTVSRDSAENTVALQMNSLKPEDTAVYYCAAXXXXXWGQGTRVTVSS

SEQ ID NO: 625 - protein, 102 aa, Artificial Sequence
  KERE-class Nanobody
  misc_feature (31)..(35): CDR
  misc_feature (50)..(54): CDR
  misc_feature (87)..(91): CDR
QVQLVESGGGLVQPGGSLRLSCTVSRLTAHXXXXXWFRQAPGKEREAVSXXXXXRFTISRDYAGNTAFLQMDSLKPEDTGVYYCATXXXXXWGQGTQVTVSS

SEQ ID NO: 626 - protein, 102 aa, Artificial Sequence
  KERE-class Nanobody
  misc_feature (31)..(35): CDR
  misc_feature (50)..(54): CDR
  misc_feature (87)..(91): CDR
EVQLVESGGELVQAGGSLKLSCTASGRNFVXXXXXWFRRAPGKEREFVAXXXXXRFTVSRDNGKNTAYLRMNSLKPEDTADYYCAVXXXXXLGSGTQVTVSS

SEQ ID NO: 627 - protein, 102 aa, Artificial Sequence
  GLEW-class Nanobody
  misc_feature (31)..(35): CDR
  misc_feature (50)..(54): CDR
  misc_feature (87)..(91): CDR
AVQLVESGGGLVQPGGSLRLSCAASGFTFSXXXXXWVRQAPGKVLEWVSXXXXXRFTISRDNAKNTLYLQMNSLKPEDTAVYYCVKXXXXXGSQGTQVTVSS

SEQ ID NO: 628 - protein, 102 aa, Artificial Sequence
  GLEW-class Nanobody
  misc_feature (31)..(35): CDR
  misc_feature (50)..(54): CDR
  misc_feature (87)..(91): CDR
EVQLVESGGGLVQPGGSLRLSCVCVSSGCTXXXXXWVRQAPGKAEEWVSXXXXXRFKISRDNAKKTLYLQMNSLGPEDTAMYYCQRXXXXXRGQGTQVTVSS

SEQ ID NO: 629 - protein, 102 aa, Artificial Sequence
  GLEW-class Nanobody
  misc_feature (31)..(35): CDR
  misc_feature (50)..(54): CDR
  misc_feature (87)..(91): CDR
EVQLVESGGGLALPGGSLTLSCVFSGSTFSXXXXXWVRHTPGKAEEWVSXXXXXRFTISRDNAKNTLYLEMNSLSPEDTAMYYCGRXXXXXRSKGIQVTVSS

SEQ ID NO: 630 - protein, 102 aa, Artificial Sequence
  P,R,S 103-class Nanobody
  misc_feature (31)..(35): CDR
  misc_feature (50)..(54): CDR
  misc_feature (87)..(91): CDR
AVQLVESGGGLVQAGGSLRLSCAASGRTFSXXXXXWFRQAPGKEREFVAXXXXXRFTISRDNAKNTVYLQMNSLKPEDTAVYYCAAXXXXXRGQGTQVTVSS

SEQ ID NO: 631 - protein, 102 aa, Artificial Sequence
  P,R,S 103-class Nanobody
  misc_feature (31)..(35): CDR
  misc_feature (50)..(54): CDR
  misc_feature (87)..(91): CDR
DVQLVESGGDLVQPGGSLRLSCAASGFSFDXXXXXWLRQTPGKGLEWVGXXXXXRFTISRDNAKNMLYLHLNNLKSEDTAVYYCRRXXXXXLGQGTQVTVSS

SEQ ID NO: 632 - protein, 102 aa, Artificial Sequence; identical to SEQ ID NO: 628
  P,R,S 103-class Nanobody
  misc_feature (31)..(35): CDR
  misc_feature (50)..(54): CDR
  misc_feature (87)..(91): CDR

SEQ ID NO: 633 - protein, 30 aa, Artificial Sequence
  KERE-class Nanobody FW1 sequence
QVQRVESGGGLVQAGGSLRLSCAASGRTSS

SEQ ID NO: 634 - protein, 30 aa, Artificial Sequence
  KERE-class Nanobody FW1 sequence
QVQLVESGGGLVQTGDSLSLSCSASGRTFS

SEQ ID NO: 635 - protein, 30 aa, Artificial Sequence
  KERE-class Nanobody FW1 sequence
QVKLEESGGGLVQAGDSLRLSCAATGRAFG

SEQ ID NO: 636 - protein, 30 aa, Artificial Sequence
  KERE-class Nanobody FW1 sequence
AVQLVESGGGLVQPGESLGLSCVASGRDFV

SEQ ID NO: 637 - protein, 30 aa, Artificial Sequence
  KERE-class Nanobody FW1 sequence
EVQLVESGGGLVQAGGSLRLSCEVLGRTAG

SEQ ID NO: 638 - protein, 30 aa, Artificial Sequence
  KERE-class Nanobody FW1 sequence
QVQLVESGGGWVQPGGSLRLSCAASETILS

SEQ ID NO: 639 - protein, 30 aa, Artificial Sequence
  KERE-class Nanobody FW1 sequence
QVQLVESGGGTVQPGGSLNLSCVASGNTFN

SEQ ID NO: 640 - protein, 30 aa, Artificial Sequence
  KERE-class Nanobody FW1 sequence
EVQLVESGGGLAQPGGSLQLSCSAPGFTLD

SEQ ID NO: 641 - protein, 30 aa, Artificial Sequence
  KERE-class Nanobody FW1 sequence
AQELEESGGGLVQAGGSLRLSCAASGRTFN

SEQ ID NO: 642 - protein, 22 aa, Artificial Sequence
  KERE-class Nanobody FW1 sequence
VESGGGLVQPGGSLRLSCAASG

SEQ ID NO: 643 - protein, 22 aa, Artificial Sequence
  KERE-class Nanobody FW1 sequence
VDSGGGLVQAGDSLKLSCALTG

SEQ ID NO: 644 - protein, 22 aa, Artificial Sequence
  KERE-class Nanobody FW1 sequence
VDSGGGLVQAGDSLRLSCAASG

SEQ ID NO: 645 - protein, 22 aa, Artificial Sequence
  KERE-class Nanobody FW1 sequence
VDSGGGLVEAGGSLRLSCQVSE

SEQ ID NO: 646 - protein, 22 aa, Artificial Sequence
  KERE-class Nanobody FW1 sequence
QDSGGGSVQAGGSLKLSCAASG

SEQ ID NO: 647 - protein, 22 aa, Artificial Sequence
  KERE-class Nanobody FW1 sequence
VQSGGRLVQAGDSLRLSCAASE

SEQ ID NO: 648 - protein, 22 aa, Artificial Sequence
  KERE-class Nanobody FW1 sequence
VESGGTLVQSGDSLKLSCASST

SEQ ID NO: 649 - protein, 22 aa, Artificial Sequence
  KERE-class Nanobody FW1 sequence
MESGGDSVQSGGSLTLSCVASG

SEQ ID NO: 650 - protein, 22 aa, Artificial Sequence
  KERE-class Nanobody FW1 sequence
QASGGGLVQAGGSLRLSCSASV

SEQ ID NO: 651 - protein, 14 aa, Artificial Sequence
  KERE-class Nanobody FW2 sequence
WFRQAPGKEREFVA

SEQ ID NO: 652 - protein, 14 aa, Artificial Sequence
  KERE-class Nanobody FW2 sequence
WFRQTPGREREFVA

SEQ ID NO: 653 - protein, 14 aa, Artificial Sequence
  KERE-class Nanobody FW2 sequence
WYRQAPGKQREMVA

SEQ ID NO: 654 - protein, 14 aa, Artificial Sequence
  KERE-class Nanobody FW2 sequence
WYRQGPGKQRELVA

SEQ ID NO: 655 - protein, 14 aa, Artificial Sequence
  KERE-class Nanobody FW2 sequence
WIRQAPGKEREGVS

SEQ ID NO: 656 - protein, 14 aa, Artificial Sequence
  KERE-class Nanobody FW2 sequence
WFREAPGKEREGIS

SEQ ID NO: 657 - protein, 14 aa, Artificial Sequence
  KERE-class Nanobody FW2 sequence
WYRQAPGKERDLVA

SEQ ID NO: 658 - protein, 14 aa, Artificial Sequence
  KERE-class Nanobody FW2 sequence
WFRQAPGKQREEVS

SEQ ID NO: 659 - protein, 14 aa, Artificial Sequence
  KERE-class Nanobody FW2 sequence
WFRQPPGKVREFVG

SEQ ID NO: 660 - protein, 32 aa, Artificial Sequence
  KERE-class Nanobody FW3 sequence
RFTISRDNAKNTVYLQMNSLKPEDTAVYRCYF

SEQ ID NO: 661 - protein, 32 aa, Artificial Sequence
  KERE-class Nanobody FW3 sequence
RFAISRDNNKNTGYLQMNSLEPEDTAVYYCAA

SEQ ID NO: 662 - protein, 32 aa, Artificial Sequence
  KERE-class Nanobody FW3 sequence
RFTVARNNAKNTVNLEMNSLKPEDTAVYYCAA

SEQ ID NO: 663 - protein, 32 aa, Artificial Sequence
  KERE-class Nanobody FW3 sequence
RFTISRDIAKNTVDLLMNNLEPEDTAVYYCAA

SEQ ID NO: 664 - protein, 32 aa, Artificial Sequence
  KERE-class Nanobody FW3 sequence
RLTISRDNAVDTMYLQMNSLKPEDTAVYYCAA

SEQ ID NO: 665 - protein, 32 aa, Artificial Sequence
  KERE-class Nanobody FW3 sequence
RFTISRDNAKNTVYLQMDNVKPEDTAIYYCAA

SEQ ID NO: 666 - protein, 32 aa, Artificial Sequence
  KERE-class Nanobody FW3 sequence
RFTISKDSGKNTVYLQMTSLKPEDTAVYYCAT

SEQ ID NO: 667 - protein, 32 aa, Artificial Sequence
  KERE-class Nanobody FW3 sequence
RFTISRDSAKNMMYLQMNNLKPQDTAVYYCAA

SEQ ID NO: 668 - protein, 32 aa, Artificial Sequence
  KERE-class Nanobody FW3 sequence
RFTISRENDKSTVYLQLNSLKPEDTAVYYCAA

SEQ ID NO: 669 - protein, 32 aa, Artificial Sequence
  KERE-class Nanobody FW3 sequence
RFTISRDYAGNTAYLQMNSLKPEDTGVYYCAT

SEQ ID NO: 670 - protein, 11 aa, Artificial Sequence
  KERE-class Nanobody FW4 sequence
WGQGTQVTVSS

SEQ ID NO: 671 - protein, 11 aa, Artificial Sequence
  KERE-class Nanobody FW4 sequence
WGKGTLVTVSS

SEQ ID NO: 672 - protein, 11 aa, Artificial Sequence
  KERE-class Nanobody FW4 sequence
RGQGTRVTVSS

SEQ ID NO: 673 - protein, 11 aa, Artificial Sequence
  KERE-class Nanobody FW4 sequence
WGLGTQVTISS

SEQ ID NO: 674 - protein, 30 aa, Artificial Sequence
  GLEW-class Nanobody FW1 sequence
QVQLVESGGGLVQPGGSLRLSCAASGFTFS

SEQ ID NO: 675 - protein, 30 aa, Artificial Sequence
  GLEW-class Nanobody FW1 sequence
EVHLVESGGGLVRPGGSLRLSCAAFGFIFK

SEQ ID NO: 676 - protein, 30 aa, Artificial Sequence
  GLEW-class Nanobody FW1 sequence
QVKLEESGGGLAQPGGSLRLSCVASGFTFS

SEQ ID NO: 677 - protein, 30 aa, Artificial Sequence
  GLEW-class Nanobody FW1 sequence
EVQLVESGGGLVQPGGSLRLSCVCVSSGCT

SEQ ID NO: 678 - protein, 30 aa, Artificial Sequence
  GLEW-class Nanobody FW1 sequence
EVQLVESGGGLALPGGSLTLSCVFSGSTFS

SEQ ID NO: 679 - protein, 22 aa, Artificial Sequence
  GLEW-class Nanobody FW1 sequence
VESGGGLVQPGGSLRLSCAASG

SEQ ID NO: 680 - protein, 22 aa, Artificial Sequence
  GLEW-class Nanobody FW1 sequence
EESGGGLAQPGGSLRLSCVASG

SEQ ID NO: 681 - protein, 22 aa, Artificial Sequence
  GLEW-class Nanobody FW1 sequence
VESGGGLALPGGSLTLSCVFSG

SEQ ID NO: 682 - protein, 14 aa, Artificial Sequence
  GLEW-class Nanobody FW2 sequence
WVRQAPGKVLEWVS

SEQ ID NO: 683 - protein, 14 aa, Artificial Sequence
  GLEW-class Nanobody FW2 sequence
WVRRPPGKGLEWVS

SEQ ID NO: 684 - protein, 14 aa, Artificial Sequence
  GLEW-class Nanobody FW2 sequence
WVRQAPGMGLEWVS

SEQ ID NO: 685 - protein, 14 aa, Artificial Sequence
  GLEW-class Nanobody FW2 sequence
WVRQAPGKEPEWVS

SEQ ID NO: 686 - protein, 14 aa, Artificial Sequence
  GLEW-class Nanobody FW2 sequence
WVRQAPGKDQEWVS

SEQ ID NO: 687 - protein, 14 aa, Artificial Sequence
  GLEW-class Nanobody FW2 sequence
WVRQAPGKAEEWVS

SEQ ID NO: 688 - protein, 14 aa, Artificial Sequence
  GLEW-class Nanobody FW2 sequence
WVRQAPGKGLEWVA

SEQ ID NO: 689 - protein, 14 aa, Artificial Sequence
  GLEW-class Nanobody FW2 sequence
WVRQAPGRATEWVS

SEQ ID NO: 690 - protein, 32 aa, Artificial Sequence
  GLEW-class Nanobody FW3 sequence
RFTISRDNAKNTLYLQMNSLKPEDTAVYYCVK

SEQ ID NO: 691 - protein, 32 aa, Artificial Sequence
  GLEW-class Nanobody FW3 sequence
RFTISRDNARNTLYLQMDSLIPEDTALYYCAR

SEQ ID NO: 692 - protein, 32 aa, Artificial Sequence
  GLEW-class Nanobody FW3 sequence
RFTSSRDNAKSTLYLQMNDLKPEDTALYYCAR

SEQ ID NO: 693 - protein, 32 aa, Artificial Sequence
  GLEW-class Nanobody FW3 sequence
RFIISRDNAKNTLYLQMNSLGPEDTAMYYCQR

SEQ ID NO: 694 - protein, 32 aa, Artificial Sequence
  GLEW-class Nanobody FW3 sequence
RFTASRDNAKNTLYLQMNSLKSEDTARYYCAR

SEQ ID NO: 695 - protein, 32 aa, Artificial Sequence
  GLEW-class Nanobody FW3 sequence
RFTISRDNAKNTLYLQMDDLQSEDTAMYYCGR

SEQ ID NO: 696 - protein, 11 aa, Artificial Sequence
  GLEW-class Nanobody FW4 sequence
GSQGTQVTVSS

SEQ ID NO: 697 - protein, 11 aa, Artificial Sequence
  GLEW-class Nanobody FW4 sequence
LRGGTQVTVSS

SEQ ID NO: 698 - protein, 11 aa, Artificial Sequence
  GLEW-class Nanobody FW4 sequence
RGQGTLVTVSS

SEQ ID NO: 699 - protein, 11 aa, Artificial Sequence
  GLEW-class Nanobody FW4 sequence
RSRGIQVTVSS

SEQ ID NO: 700 - protein, 11 aa, Artificial Sequence
  GLEW-class Nanobody FW4 sequence
WGKGTQVTVSS

SEQ ID NO: 701 - protein, 11 aa, Artificial Sequence
  GLEW-class Nanobody FW4 sequence
WGQGTQVTVSS

SEQ ID NO: 702 - protein, 30 aa, Artificial Sequence
  P,R,S 103-class Nanobody FW1 sequence
AVQLVESGGGLVQAGGSLRLSCAASGRTFS

SEQ ID NO: 703 - protein, 30 aa, Artificial Sequence
  P,R,S 103-class Nanobody FW1 sequence
QVQLQESGGGMVQPGGSLRLSCAASGFDFG

SEQ ID NO: 704 - protein, 30 aa, Artificial Sequence; identical to SEQ ID NO: 675
  P,R,S 103-class Nanobody FW1 sequence

SEQ ID NO: 705 - protein, 30 aa, Artificial Sequence
  P,R,S 103-class Nanobody FW1 sequence
QVQLAESGGGLVQPGGSLKLSCAASRTIVS

SEQ ID NO: 706 - protein, 30 aa, Artificial Sequence
  P,R,S 103-class Nanobody FW1 sequence
QEHLVESGGGLVDIGGSLRLSCAASERIFS

SEQ ID NO: 707 - protein, 30 aa, Artificial Sequence; identical to SEQ ID NO: 676
  P,R,S 103-class Nanobody FW1 sequence

SEQ ID NO: 708 - protein, 30 aa, Artificial Sequence; identical to SEQ ID NO: 677
  P,R,S 103-class Nanobody FW1 sequence

SEQ ID NO: 709 - protein, 30 aa, Artificial Sequence; identical to SEQ ID NO: 678
  P,R,S 103-class Nanobody FW1 sequence

SEQ ID NO: 710 - protein, 22 aa, Artificial Sequence
  P,R,S 103-class Nanobody FW1 sequence
VESGGGLVQAGGSLRLSCAASG

SEQ ID NO: 711 - protein, 22 aa, Artificial Sequence
  P,R,S 103-class Nanobody FW1 sequence
AESGGGLVQPGGSLKLSCAASR

SEQ ID NO: 712 - protein, 14 aa, Artificial Sequence
  P,R,S 103-class Nanobody FW2 sequence
WFRQAPGKEREFVA

SEQ ID NO: 713 - protein, 14 aa, Artificial Sequence
  P,R,S 103-class Nanobody FW2 sequence
WVRQAPGKVLEWVS

SEQ ID NO: 714 - protein, 14 aa, Artificial Sequence
  P,R,S 103-class Nanobody FW2 sequence
WVRRPPGKGLEWVS

SEQ ID NO: 715 - protein, 14 aa, Artificial Sequence
  P,R,S 103-class Nanobody FW2 sequence
WIRQAPGKEREGVS

SEQ ID NO: 716 - protein, 14 aa, Artificial Sequence
  P,R,S 103-class Nanobody FW2 sequence
WVRQYPGKEPEWVS

SEQ ID NO: 717 - protein, 14 aa, Artificial Sequence
  P,R,S 103-class Nanobody FW2 sequence
WFRQPPGKEHEFVA

SEQ ID NO: 718 - protein, 14 aa, Artificial Sequence
  P,R,S 103-class Nanobody FW2 sequence
WYRQAPGKRTELVA

SEQ ID NO: 719 - protein, 14 aa, Artificial Sequence
  P,R,S 103-class Nanobody FW2 sequence
WLRQAPGQGLEWVS

SEQ ID NO: 720 - protein, 14 aa, Artificial Sequence
  P,R,S 103-class Nanobody FW2 sequence
WLRQTPGKGLEWVG

SEQ ID NO: 721 - protein, 14 aa, Artificial Sequence
  P,R,S 103-class Nanobody FW2 sequence
WVRQAPGKAEEFVS

SEQ ID NO: 722 - protein, 32 aa, Artificial Sequence
  P,R,S 103-class Nanobody FW3 sequence
RFTISRDNAKNTVYLQMNSLKPEDTAVYYCAA

SEQ ID NO: 723 - protein, 32 aa, Artificial Sequence; identical to SEQ ID NO: 691
  P,R,S 103-class Nanobody FW3 sequence

SEQ ID NO: 724 - protein, 32 aa, Artificial Sequence
  P,R,S 103-class Nanobody FW3 sequence
RFTISRDNAKNEMYLQMNNLKTEDTGVYWCGA

SEQ ID NO: 725 - protein, 32 aa, Artificial Sequence
  P,R,S 103-class Nanobody FW3 sequence
RFTISSDSNRNMIYLQMNNLKPEDTAVYYCAA

SEQ ID NO: 726 - protein, 32 aa, Artificial Sequence
  P,R,S 103-class Nanobody FW3 sequence
RFTISRDNAKNMLYLHLNNLKSEDTAVYYCRR

SEQ ID NO: 727 - protein, 32 aa, Artificial Sequence
  P,R,S 103-class Nanobody FW3 sequence
RFTISRDNAKKTVYLRLNSLNPEDTAVYSCNL

SEQ ID NO: 728 - protein, 32 aa, Artificial Sequence
  P,R,S 103-class Nanobody FW3 sequence
RFKISRDNAKKTLYLQMNSLGPEDTAMYYCQR

SEQ ID NO: 729 - protein, 32 aa, Artificial Sequence
  P,R,S 103-class Nanobody FW3 sequence
RFTVSRDNGKNTAYLRMNSLKPEDTADYYCAV

SEQ ID NO: 730 - protein, 11 aa, Artificial Sequence
  P,R,S 103-class Nanobody FW4 sequence
RGQGTQVTVSS

SEQ ID NO: 731 - protein, 11 aa, Artificial Sequence
  P,R,S 103-class Nanobody FW4 sequence
LRGGTQVTVSS

SEQ ID NO: 732 - protein, 11 aa, Artificial Sequence
  P,R,S 103-class Nanobody FW4 sequence
GNKGTLVTVSS

SEQ ID NO: 733 - protein, 11 aa, Artificial Sequence
  P,R,S 103-class Nanobody FW4 sequence
SSPGTQVTVSS

SEQ ID NO: 734 - protein, 11 aa, Artificial Sequence
  P,R,S 103-class Nanobody FW4 sequence
SSQGTLVTVSS

SEQ ID NO: 735 - protein, 11 aa, Artificial Sequence
  P,R,S 103-class Nanobody FW4 sequence
RSRGIQVTVSS

SEQ ID NO: 736 - protein, 30 aa, Artificial Sequence
  FR1 sequence
EVQLVESGGGLVQPGGSLRLSCAASGSIFS

SEQ ID NO: 737 - protein, 30 aa, Artificial Sequence
  FR1 sequence
EVQLVESGGGLVQAGDSLRLSCTATGRTSS

SEQ ID NO: 738 - protein, 30 aa, Artificial Sequence
  FR1 sequence
EVQLVESGGGLVQAGGSLRLSCATSGFTFS

SEQ ID NO: 739 - protein, 30 aa, Artificial Sequence
  FR1 sequence
KVQLVESGGGLVQAGGSLRLSCAASGRTFS

SEQ ID NO: 740 - protein, 30 aa, Artificial Sequence
  FR1 sequence
EVQLVESGGGLVQAGDSLRLSCAATGRTSS

SEQ ID NO: 741 - protein, 30 aa, Artificial Sequence
  FR1 sequence
EVQLVESGGGLVQAGGSLRLSCVASGRTLR

SEQ ID NO: 742 - protein, 30 aa, Artificial Sequence
  FR1 sequence
EVQLVESGGGLVQAGGSLRLTCAASGRTFS

SEQ ID NO: 743 - protein, 30 aa, Artificial Sequence
  FR1 sequence
EVQLVESGGGLVQAGGSLRLSCAASGLTFN

SEQ ID NO: 744 - protein, 30 aa, Artificial Sequence; identical to SEQ ID NO: 740
  FR1 sequence

SEQ ID NO: 745 - protein, 5 aa, Artificial Sequence
  CDR sequence
DNVMG

SEQ ID NO: 746 - protein, 5 aa, Artificial Sequence
  CDR sequence
IYNMD

SEQ ID NO: 747 - protein, 5 aa, Artificial Sequence
  CDR sequence
RFDMS

SEQ ID NO: 748 - protein, 5 aa, Artificial Sequence
  CDR sequence
SYFMG

SEQ ID NO: 749 - protein, 5 aa, Artificial Sequence
  CDR sequence
IYNMD

SEQ ID NO: 750 - protein, 5 aa, Artificial Sequence
  CDR sequence
RYVTG

SEQ ID NO: 751 - protein, 5 aa, Artificial Sequence
  CDR sequence
SFVIG

SEQ ID NO: 752 - protein, 5 aa, Artificial Sequence
  CDR sequence
QYTIT

SEQ ID NO: 753 - protein, 5 aa, Artificial Sequence
  CDR sequence
IYNMD

SEQ ID NO: 754 - protein, 14 aa, Artificial Sequence
  FR2 sequence
WYRQAPGKQRELVA

SEQ ID NO: 755 - protein, 14 aa, Artificial Sequence
  FR2 sequence
WFRQTPGKERELIA

SEQ ID NO: 756 - protein, 14 aa, Artificial Sequence
  FR2 sequence
WFRQAPGKQREFIA

SEQ ID NO: 757 - protein, 14 aa, Artificial Sequence
  FR2 sequence
WFRQAPGKEREVVA

SEQ ID NO: 758 - protein, 14 aa, Artificial Sequence
  FR2 sequence
WFLQAPGKERELIA

SEQ ID NO: 759 - protein, 14 aa, Artificial Sequence
  FR2 sequence
WFRQAPGKEREVVA

SEQ ID NO: 760 - protein, 14 aa, Artificial Sequence
  FR2 sequence
WFRQAPGKQREVVA

SEQ ID NO: 761 - protein, 14 aa, Artificial Sequence
  FR2 sequence
WFRQAPGKEREFVA

SEQ ID NO: 762 - protein, 14 aa, Artificial Sequence
  FR2 sequence
WFRQGSGKGRELIA

SEQ ID NO: 763 - protein, 16 aa, Artificial Sequence
  CDR sequence
TIWSSGHTNYADSVKG

SEQ ID NO: 764 - protein, 17 aa, Artificial Sequence
  CDR sequence
RLWWRSGSTYYADSVKG

SEQ ID NO: 765 - protein, 16 aa, Artificial Sequence
  CDR sequence
TIFSGGDTDYIDSVKG

SEQ ID NO: 766 - protein, 17 aa, Artificial Sequence
  CDR sequence
TIRWSDGSTYYEDSVKG

SEQ ID NO: 767 - protein, 17 aa, Artificial Sequence
  CDR sequence
RIWWRSGATYYADSVKG

SEQ ID NO: 768 - protein, 17 aa, Artificial Sequence
  CDR sequence
SISWSGESTYYADSVKG

SEQ ID NO: 769 - protein, 16 aa, Artificial Sequence
  CDR sequence
SITSGGSTYYEDSGKG

SEQ ID NO: 770 - protein, 17 aa, Artificial Sequence
  CDR sequence
AVSWSGSSESVSNSVKG

SEQ ID NO: 771 - protein, 17 aa, Artificial Sequence
  CDR sequence
RIWWRSGETYYADSVKG

SEQ ID NO: 772 - protein, 32 aa, Artificial Sequence
  FR3 sequence
RFTISRDNAKNTVYLQMNSLKPEDTAVYYCNL

SEQ ID NO: 773 - protein, 32 aa, Artificial Sequence
  FR3 sequence
RFTISRDNAKNTVYLQMNSLKPEDTSVYICTA

SEQ ID NO: 774 - protein, 32 aa, Artificial Sequence
  FR3 sequence
RFTISRDNAKNTVYLQMNSLKPEDTAVYYCCP

SEQ ID NO: 775 - protein, 32 aa, Artificial Sequence; identical to SEQ ID NO: 722
  FR3 sequence

SEQ ID NO: 776 - protein, 32 aa, Artificial Sequence
  FR3 sequence
RFTISRGNAKNTVYLQMNSLKPEDTGVYHCTA

SEQ ID NO: 777 - protein, 32 aa, Artificial Sequence
  FR3 sequence
RFAISRDNAKNAVYLQMNSLNLEDTGVYYCAE

SEQ ID NO: 778 - protein, 32 aa, Artificial Sequence
  FR3 sequence
RFTISRDNAKNRVYLQMNSLRPEDTAVYYCAA

SEQ ID NO: 779 - protein, 32 aa, Artificial Sequence
  FR3 sequence
RFTISRDNAKNTAYLAMNSLKPEDTAVYYCAA

SEQ ID NO: 780 - protein, 32 aa, Artificial Sequence
  FR3 sequence
RFTISRDNAKNTVYLQMNSLKPEDTNVYHCAA

SEQ ID NO: 781 - protein, 12 aa, Artificial Sequence
  CDR sequence
GTIVTGTWRSDY

SEQ ID NO: 782 - protein, 10 aa, Artificial Sequence
  CDR sequence
GDTGGAAYGY

SEQ ID NO: 783 - protein, 6 aa, Artificial Sequence
  CDR sequence
LGIEYA

SEQ ID NO: 784 - protein, 9 aa, Artificial Sequence
  CDR sequence
AKGIGVYGY

SEQ ID NO: 785 - protein, 10 aa, Artificial Sequence
  CDR sequence
GVTGGAAYGY

SEQ ID NO: 786 - protein, 9 aa, Artificial Sequence
  CDR sequence
AELPGTYDY

SEQ ID NO: 787 - protein, 9 aa, Artificial Sequence
  CDR sequence
AEPAGVYDV

SEQ ID NO: 788 - protein, 15 aa, Artificial Sequence
  CDR sequence
DRRGLASTRAADYDY

SEQ ID NO: 789 - protein, 10 aa, Artificial Sequence
  CDR sequence
GDTGGASYGY

SEQ ID NO: 790 - protein, 11 aa, Artificial Sequence
  FR4 sequence
WGQGTQVTVSS

SEQ ID NO: 791 - protein, 11 aa, Artificial Sequence
  FR4 sequence
WGQGTQVTVSS

SEQ ID NO: 792 - protein, 11 aa, Artificial Sequence
  FR4 sequence
WGQGTQVTVSS

SEQ ID NO: 793 - protein, 11 aa, Artificial Sequence
  FR4 sequence
WGQGTQVTVSS

SEQ ID NO: 794 - protein, 11 aa, Artificial Sequence
  FR4 sequence
WGQGTQVTVSS

SEQ ID NO: 795 - protein, 11 aa, Artificial Sequence
  FR4 sequence
WGQGTQVTVSS

SEQ ID NO: 796 - protein, 11 aa, Artificial Sequence
  FR4 sequence
WGQGTQVTVSS

SEQ ID NO: 797 - protein, 11 aa, Artificial Sequence
  FR4 sequence
WGQGTQVTVSS

SEQ ID NO: 798 - protein, 11 aa, Artificial Sequence
  FR4 sequence
WGQGTQVTVSS

SEQ ID NO: 799 - protein, 120 aa, Artificial Sequence
  Nanobody
EVQLVESGGGLVQPGGSLRLSCAASGSIFSDNVMGWYRQAPGKQRELVATIWSSGHTNYADSVKGRFTISRDNAKNTVYLQMNSLKPEDTAVYYCNLGTIVTGTWRSDYWGQGTQVTVSS

SEQ ID NO: 800 - protein, 119 aa, Artificial Sequence
  Nanobody
EVQLVESGGGLVQAGDSLRLSCTATGRTSSIYNMDWFRQTPGKERELIARLWWRSGSTYYADSVKGRFTISRDNAKNTVYLQMNSLKPEDTSVYICTAGDTGGAAYGYWGQGTQVTVSS

SEQ ID NO: 801 - protein, 114 aa, Artificial Sequence
  Nanobody
EVQLVESGGGLVQAGGSLRLSCATSGFTFSRFDMSWFRQAPGKQREFIATIFSGGDTDYIDSVKGRFTISRDNAKNTVYLQMNSLKPEDTAVYYCCPLGIEYAWGQGTQVTVSS

SEQ ID NO: 802 - protein, 118 aa, Artificial Sequence
  Nanobody
KVQLVESGGGLVQAGGSLRLSCAASGRTFSSYFMGWFRQAPGKEREVVATIRWSDGSTYYEDSVKGRFTISRDNAKNTVYLQMNSLKPEDTAVYYCAAAKGIGVYGYWGQGTQVTVSS

SEQ ID NO: 803 - protein, 119 aa, Artificial Sequence
  Nanobody
EVQLVESGGGLVQAGDSLRLSCAATGRTSSIYNMDWFLQAPGKERELIARIWWRSGATYYADSVKGRFTISRGNAKNTVYLQMNSLKPEDTGVYHCTAGVTGGAAYGYWGQGTQVTVSS

SEQ ID NO: 804 - protein, 118 aa, Artificial Sequence
  Nanobody
EVQLVESGGGLVQAGGSLRLSCVASGRTLRRYVTGWFRQAPGKEREVVASISWSGESTYYADSVKGRFAISRDNAKNAVYLQMNSLNLEDTGVYYCAEAELPGTYDYWGQGTQVTVSS

SEQ ID NO: 805 - protein, 117 aa, Artificial Sequence
  Nanobody
EVQLVESGGGLVQAGGSLRLTCAASGRTFSSFVIGWFRQAPGKQREVVASITSGGSTYYEDSGKGRFTISRDNAKNRVYLQMNSLRPEDTAVYYCAAAEPAGVYDVWGQGTQVTVSS

SEQ ID NO: 806 - protein, 124 aa, Artificial Sequence
  Nanobody
EVQLVESGGGLVQAGGSLRLSCAASGLTFNQYTITWFRQAPGKEREFVAAVSWSGSSESVSNSVKGRFTISRDNAKNTAYLAMNSLKPEDTAVYYCAADRRGLASTRAADYDYWGQGTQVTVSS

SEQ ID NO: 807 - protein, 119 aa, Artificial Sequence
  Nanobody
EVQLVESGGGLVQAGDSLRLSCAATGRTSSIYNMDWFRQGSGKGRELIARIWWRSGETYYADSVKGRFTISRDNAKNTVYLQMNSLKPEDTNVYHCAAGDTGGASYGYWGQGTQVTVSS

SEQ ID NO: 808 - protein, 213 aa, Homo sapiens
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQTVQLLCPGGEAPRARKVRLVASCKCKRLTRFHNQSELKDFGTEAARPQKGRKPRPRARSAKANQAELENAY

SEQ ID NO: 809 - protein, 213 aa, Artificial Sequence
  Recombinant sclerostin
MPLLLLLPLLWAGALAHHHHHHHQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

The invention claimed is:

1. A method for increasing at least one of bone formation, bone mineral density, bone mineral content, bone mass, bone quality and bone strength in a mammalian subject in need thereof, which method comprises:
(a) administering at least two initial doses of sclerostin antibody to a subject in need of such treatment, wherein the initial doses are administered every month or every four weeks, and wherein the sclerostin antibody comprises a set of 6 CDRs set forth in SEQ ID NOs: 245-247 and SEQ ID NOs: 78-80;
(b) administering further doses of sclerostin antibody to the subject, wherein each of the further doses is at least 210 mg, wherein the further doses are administered once every two months or once every four months, and wherein together (a) and (b) comprise administering a batch of doses comprising at least twelve doses of sclerostin antibody;
(c) allowing a dosing holiday that is at least two times greater than the length of the interval between the doses in (b); and
(d) administering to the subject at least one further dose of sclerostin antibody after the dosing holiday of (c).

2. The method of claim 1, wherein: the doses of (a) and (b) represent a batch of doses after which the subject is given a dosing holiday.

3. The method of claim 1, wherein the method comprises after at least two of the doses of (b), monitoring the subject to identify whether the subject shows a reduced response to a dose of the sclerostin antibody, and where such a reduced response is identified, allowing the subject a dosing holiday which is at least two times greater than the length of the interval between the doses in (b).

4. The method of claim 1, wherein: together (a) and (b) comprise administering a batch of doses comprising 25 doses of the sclerostin antibody.

5. The method of claim 1, wherein the doses of (a) comprise an initial loading dose and either the further doses of (a) or those of (b) comprise doses which are lower than the initial loading dose.

6. The method of claim 1, wherein:
(i) the doses of (a) are from 300 mg to 2500 mg;
(ii) the doses of (a) are from 500 mg to 2000 mg:, or, (iii) the doses of (a) are from 400 mg to 700 mg.

7. The method of claim 1, wherein the initial doses of (a) are administered monthly for a period of twelve months.

8. The method of claim 1, wherein the method comprises administering a different drug to increase at least one of bone formation, bone mineral density, bone mineral content, bone mass, bone quality and bone strength during the dosing holiday.

9. The method of claim 8, wherein the different drug is an anti-resorptive.

10. The method of claim 9, wherein the anti-resorptive is a bisphosphonate.

11. The method of claim 1, where the subject:
(i) has been diagnosed with a bone disorder and the method is the first treatment for the disorder that the subject is given since diagnosis; or
(ii) the subject has been identified as one at risk of bone fracture or has a bone fracture.

12. The method of claim 1, wherein the sclerostin antibody:
demonstrates a binding affinity for sclerostin of SEQ ID NO: 1 of less than or equal to $1 \times 10^{-7}$ M;
(ii) neutralizes human sclerostin in a MC3T3 cell-based mineralization assay;
(iii) has an $IC_{50}$ of 100 nM or less, 50 nM or less, or 25 nM or less for neutralizing human sclerostin in a cell-based assay;
(iv) has an $IC_{50}$ of 100 nM or less for neutralizing human sclerostin in a cell-based Wnt signalling assay in HEK293 cells; and/or
(vi) has an $IC_{50}$ of 500 nM or less for neutralizing human sclerostin in a BMP2-induced mineralization assay in MC3T3 cells.

13. The method of claim 12, wherein the cell-based assay of (iii) is a bone specific alkaline phosphatase assay.

* * * * *